US007732664B2

(12) United States Patent
Souza et al.

(10) Patent No.: US 7,732,664 B2
(45) Date of Patent: Jun. 8, 2010

(54) GENES ASSOCIATED TO SUCROSE CONTENT

(75) Inventors: Glaucia Mendes Souza, Sao Paulo (BR); Flavia Stal Papini-Terzi, Sao Paulo (BR); Flavia Riso Rocha, Sao Paulo (BR); Alessandro Jaquiel Waclawovsky, Sao Paulo (BR); Ricardo Zorzetto Nicollielo Vencio, Sao Paulo (BR); Josélia Oliveira Marques, Sao Paulo (BR); Juliana de Maria Felix, Campinas (BR); Marcelo Menossi Teixeira, Campinas (BR); Marcos Buckeridge, Rua do Matao (BR); Amanda Pereira de Souza, Rua do Matao (BR); Eugênio César Ulian, Piracicaba (BR)

(73) Assignees: Universidade de Sao Paulo - USP., Sao Paulo (BR); Universidade Estadual de Campinas - Unicamp., Sao Paulo (BR); Fundacao de Amparo a Pesquisa do Estado de Sao Paulo - Fapesp., Sao Paulo (BR); Centro de Tecnologia Canavieira, Sao Paulo (BR); Central de Alcool Lucelia Ltda., Sao Paulo (BR)

( * ) Notice: Subject to any disclaimer, the term of this patent is extended or adjusted under 35 U.S.C. 154(b) by 56 days.

(21) Appl. No.: 11/716,262

(22) Filed: Mar. 8, 2007

(65) Prior Publication Data

US 2007/0292874 A1 Dec. 20, 2007

Related U.S. Application Data

(60) Provisional application No. 60/780,693, filed on Mar. 8, 2006, provisional application No. 60/861,496, filed on Nov. 27, 2006.

(51) Int. Cl.
*A01H 5/00* (2006.01)
*A01H 5/04* (2006.01)
*A01H 5/10* (2006.01)
*C12N 15/82* (2006.01)
*C12N 15/00* (2006.01)

(52) U.S. Cl. .............. 800/285; 800/278; 800/295; 800/298; 435/320.1; 536/23.1

(58) Field of Classification Search ............ None
See application file for complete search history.

(56) References Cited

OTHER PUBLICATIONS

Colliver et al 1997 Plant Molecular Biology 35:509-522.*
International Search Report mailed Sep. 30, 2008, for PCT Application No. PCT/BR07/00282 filed Aug. 22, 2007, 4 pages.
Papini-Terzi, F.S. et al. (2005). "Transcription Profiling of Signal Transduction-related Genes in Sugarcane Tissues," *DNA Research* 12:27-38.
Rolland, F. et al. (2002). "Sugar Sensing and Signaling in Plants," *Plant Cell* 14:S185-S205.
Vettore, AL. et al. (2003). "Analysis and Functional Annotation of an Expressed Sequence Tag Collection for Tropical Sugarcane," *Genome Research* 13:2725-2735.

\* cited by examiner

*Primary Examiner*—Anne Marie Grunberg
*Assistant Examiner*—Brent Page
(74) *Attorney, Agent, or Firm*—Morrison & Foerster LLP

(57) ABSTRACT

Modern sugarcane cultivars are complex hybrids resulting from crosses among several species of the *Saccharum* genus. Traditional breeding methods have been extensively employed in different countries along the past decades to develop varieties with increased sucrose yield, and resistant to plagues and diseases. Conventional varietal improvement is, however, limited by the narrow pool of suitable markers. In this sense, molecular genetics is seen as a promising tool to assist in the process of molecular marker identification. The present invention concerns the identification of 348 genes associated with sucrose content in sugarcane plants. The genes were found to be differentially expressed when high sucrose and low sucrose plants and populations of plants were compared and/or when high and low sucrose internodes were compared. The expression data was obtained using cDNA microarray and quantitative PCR technologies. The genes identified can be used to identify, distinguish, characterize and/or develop plants with increased sucrose content. More preferably SEQ ID Nos: 1 to 203 should be useful as molecular markers. SEQ ID Nos: 204 to 228 are given as controls or examples of genes never associated with sucrose content. SEQ ID Nos. 1-203 and SEQ ID Nos. 229 to 373 can be targeted in the development of transgenic or non-transgenic varieties with increased sucrose content.

2 Claims, 9 Drawing Sheets

Sequence Alignment of SEQ ID No. 411: CIPK-8 (SCEQLB2019B08.g); SEQ ID No. 412: CIPK-29 (SCSGHR1070F12.g); and SEQ ID No. 413: CIPK-1 (SCCCCL5001D11.g) using CLUSTALW

```
SCEQLB2019B08.g      ---------TTCCAGGAGGACAGTGAAACCACAGGACCGAGCGGAGAAGACTCCTGACATTCATTCCATTCCGTTCCAAAGGGGGTGAC
SCSGHR1070F12.g      ---------TCCAGCTGCCTGACAGTGAAACCACAGGACCGAGCGGAGAAGACTCCTGACATTCATTCCATTCCGTTCCAAAGGGGGTGA
SCCCCL5001D11.g      GGGAGCAGATACAGCTCCTGACAGTGAAACCTTGCCTCCTCTAGAATCCTCCTGCGCCGCGTCA---------AAAGGCAGTAAGGCA

SCEQLB2019B08.g      GGAATGAGTACAACCAAGGTGAAGAGACGTGTGGGCAAGTATGAGCTCGGCCGCACCATAGGCGAGGGCACATTCGCAAAGGTCAGGTTCC
SCSGHR1070F12.g      GGAATGAGTACAACCAAGGTGAAGAGACGTGTGGGCAAGTATGAGCTCGGCCGCACCATAGGCGAGGGCACATTCGCAAAGGTCAGGTTCC
SCCCCL5001D11.g      GGAATGAGTACAACCAAGGTGAAGAGACGTGTGGGCAAGTATGAGCTCAECCCTAGGCGAGGCACATTCGCAAAGGTCAGGTTCACACA

SCEQLB2019B08.g      CGGTGACCAGCGAGGCCGTAGCCATCAAGATCCTAGATAAGGAGAAGGTACTCAAGCACAAGATGGTTGAGCAGATTAAGCGGGAAATCTC
SCSGHR1070F12.g      CGGTGACCAGCGAGGCCGTAGCCATCAAGATCCTAGATAAGGAGAAGGTACTCAAGCACAAGATGGTTGAGCAGATTAAGCGGGAAATCTC
SCCCCL5001D11.g      CGCAGACCGACGACCGGTAGCCATCAAGATCCTAGATAAAGAAGGCCTCAGCACAAGATGGTTGAGCAGATTAAGCGGGATAGAGATGAA

SCEQLB2019B08.g      GTTGATCAAGCACCCTAATGTTGTCCGCATATACGAGGTGATGGGAAGTAAAACAAAGATCTACATTGTGTTCCATGGTGGCGAGCCTT
SCSGHR1070F12.g      GTTGATCAAGCACCCTAATGTTGTCCGCATATACGAGGTGATGGGAAATAAAGATCTACATTGTGTTAC----------------------
SCCCCL5001D11.g      GTTGATAAGCATCCTAATGTTGTCGCATATGAGGTGATGGGAAGTAAAACAAAGTACATTGTGCGACTATCTACTGGTGGCGAGCTTT
```

FIGURE 7

GENES ASSOCIATED TO SUCROSE CONTENT

RELATED APPLICATIONS

This application claims the benefit of U.S. Provisional Application No. 60/780,693, titled SUGAR CANE WITH INCREASED SUGAR LEVELS, filed Mar. 8, 2006, and U.S. Provisional Application No. 60/861,496, titled GENES ASSOCIATED TO SUCROSE CONTENT, filed Nov. 27, 2006, both of which are hereby incorporated by reference in their entirety.

FIELD OF THE INVENTION

The present invention refers to a method for discriminating plants with different abilities to accumulate sugars as well as methods to produce plants with increased sucrose content.

BACKGROUND OF THE INVENTION

The tropical crop sugarcane is of great economical interest, contributing to about two thirds of the world's raw sugar production (Pessoa Jr. et al., 2005). In some countries, part of the crop is destined to the production of ethanol, an important alternative energy source and a less polluting fuel. Due to its unique capacity of storing sucrose in the stems, sugarcane is an interesting model for studies on sugar synthesis, transport and accumulation. Sugarcane is a C4 grass capable of accumulating sucrose in its stems to levels exceeding 50% of its dry weight. Stem internodes mature progressively towards the base of the culm and there is a corresponding increase in sucrose concentration. Sucrose metabolism components and regulators are likely to be key players in determining sugarcane sucrose yield (Moore, 2005; Lunn and Furbank, 1999). Sugarcane is a complex polyploid grass with commercial varieties derived from conventional breeding. Recent yield data indicates that this technology may be reaching a limit in sugar productivity increases. It could be greatly advantageous to have genes associated with desirable traits targeted for directed improvement of varieties. Traditional breeding methods have been extensively employed in different countries along the past decades to develop varieties with increased sucrose yield, and resistant to plagues and diseases. Conventional varietal improvement is, however, limited by the narrow pool of suitable markers. In this sense, molecular genetics is seen as a promising tool to assist in the process of molecular marker identification. Knowledge on the genes that participate in sucrose content regulation may assist in the development of new varieties with increased productivity. This improvement is not only economically relevant, but has also a strong environmental appeal, considering it can lessen the need to expand cultivation areas and that ethanol is a source for renewable energy. Furthermore, a broader understanding of the highly specialized sugar production and accumulation mechanisms in sugarcane can bring new insights into sugar metabolism in other species.

Sugarcane is the common name given to the several species of the genus *Saccharum*, native to Asia, but cultivated for centuries in all five continents. It is a very efficient photosynthesizer making it one of the world's most important crop grasses. Sugarcane is perennial and has sturdy, jointed fibrous stalks 2-6 m tall, capable of storing large quantities of sucrose. Its cultivation requires warm and humid tropical or subtropical climate. Brazil, India and China are the largest producers. The major commercial cultivars are complex hybrids selected from crosses between *S. officinarum*, *S. barberi*, *S. robustum*, *S. spontaneum* and *S. edule*, as well as related genera that cross with *Saccharum*, such as *Erianthus*, *Miscanthus*, *Narenga* and *Sclerostachya*.

*S. spontaneum* genotypes, found from Afghanistan to the South Pacific Islands, have the broadest geographical distribution in the genus *Saccharum*. Together with *S. officinarum*, it is the species most used in breeding programs aiming to improve vigor, fiber content, ratooning ability, environmental stress and disease resistance (Perez et al., 1997). The origin of *S. spontaneum* is not yet clear. It is believed that it might have originated from an introgression of *Miscanthus*, *Erianthus* and *Sclerostachya* (Roach and Daniels, 1987). *S. officinarum* genotypes have originated in New Guinea from *S. robustum* by natural and/or human selection. They produce thick stems and are capable of accumulating high levels of sucrose. They do not flower abundantly and are usually used as females in breeding programs (Perez et al., 1997).

The sequencing of 238 thousand sugarcane ESTs (Expressed Sequence Tags) by the Brazilian consortium SUCEST (Vettore et al., 2003) was a landmark for the sugarcane biotechnology field and also for the study of basic genetics and physiology of grasses. The ESTs were clustered and a total of 43 thousand SAS (Sugarcane Assembled Sequences) were identified and categorized (Vettore et al., 2003). Functional characterization of the transcripts can be viewed on the World Wide Web at sucest-fun.org.

This work describes the use of cDNA microarrays to identify genes differentially expressed in two sugarcane populations contrasting for sugar content. The methods used to identify differential expression, the construction of cDNA microarrays, hybridization conditions and data analysis have been previously described (Papini-Terzi et al., 2005). A total of 5154 genes had their expression profiled.

The plants analyzed in the present invention are derived from multiple crossings among *S. officinarum* and *S. spontaneum* genotypes and from commercial varieties that have been selected for sugar content for over 12-15 years. A useful strategy for target-gene identification has been denominated "genetical genomics". First introduced by Jansen and Nap (2001), the method aims to apply large-scale analysis of gene expression to a segregating population. The use of cDNA microarrays to evaluate a sugarcane population that segregates for a certain trait may provide more insight into plant signaling and gene function than classical mutagenesis studies (Meyers et al., 2004). Although *S. officinarum* and *S. spontaneum* present a large genetic variability in nature, very few representatives participated in the generation of the modern commercial hybrids. Certainly, there are genes conferring favourable traits to be identified among them that can be explored in breeding programs. Likewise, the comparison of progenies from different commercial varieties carefully selected for sucrose enrichment is a strategy that can point to genes that have been selected for over the years by traditional breeding methods.

SUMMARY OF THE INVENTION

This invention provides methods for producing transgenic plants, and non-naturally occurring plants with increased sugar levels. The invention further provides methods for determining the ability of a plant to accumulate sugar as well as methods for altering the ability of plants to accumulate sugar. In preferred embodiments, the plants are from the genus *Saccharum*. In particularly preferred embodiments, the plants are sugarcane.

In some embodiments, the invention provides methods for determining the ability of a plant to accumulate sugar by providing a plant sample and measuring the expression level in the sample of at least one polynucleotide having sequence identity to or comprising SEQ ID NO:s 1 to 203 or SEQ ID NO:s 229 to 373, their complements, and sequences which hybridize to SEQ ID NO:s 1 to 203 or SEQ ID NO:s 229 to 373 under high stringency conditions. High stringency conditions refers to hybridization to filter-bound DNA in 5×SSC, 2% sodium dodecyl sulfate (SDS), 100 ug/ml single stranded DNA at 55-65° C., and washing in 0.1×SSC and 0.1% SDS at 60-65° C. For example, the polynucleotide can have 65% sequence identity, 75% sequence identity, 85% sequence identity, 95% sequence identity, 99% sequence identity, or be identical. In other embodiments, the polynucleotide is a fragment at least 14 nucleotides length of SEQ ID NO:s 1 to 203 or SEQ ID NO:s 229 to 373, their complements, and sequences which hybridize to SEQ ID NO:s 1 to 203 or SEQ ID NO:s 229 to 373 under high stringency conditions.

Polynucleotide expression levels are preferably detected by measurement of RNA levels, which can be detected by any method known to those of skill in the art, preferably PCR or hybridization to oligonucleotides. Samples are preferably taken from the leaf, internode, lateral bud, root, or inflorescence.

In other embodiments, the invention provides methods for determining the ability of a plant to accumulate sugar by providing a plant sample and measuring the expression level in the sample of at least one polypeptide encoded by polynucleotides having sequence identity to or comprising SEQ NO:s 1 to 203 or SEQ ID NO:s 229 to 373, their complements, and sequences which hybridize to SEQ ID NO:s 1 to 203 or SEQ ID NO:s 229 to 373 under high stringency conditions. For example, the polynucleotide can have 65% sequence identity, 75% sequence identity, 85% sequence identity, 95% sequence identity, 99% sequence identity, or be identical.

In still other embodiments, the invention provides methods for determining the ability of a plant to accumulate sugar by providing a plant sample and measuring the expression level in the sample of at least one polypeptide having similarity or comprising a polypeptide encoded by SEQ ID NO:s 1 to 203 or SEQ ID NO:s 229 to 373. The similarity, for example, can be 65%, 75%, 85%, 95%, 99%, or 100%.

In other embodiments, the invention provides methods for altering the ability of a plant to accumulate sugar by providing a plant sample, modulating the expression level of at least one of SEQ ID NO:s 1 to 203 or SEQ ID NO:s 229 to 373 and detecting the expression level of at least one of SEQ ID NO:s 1 to 203 or SEQ ID NO:s 229 to 373. The modulation can be achieved by mutagenesis, preferably by chemical or physical mutagenesis.

In yet another embodiment, the invention provides methods for altering the ability of a plant to accumulate sugar by providing a plant sample, expressing or interfering with the expression of at least one polynucleotide having sequence identity to or comprising SEQ ID NO:s 1 to 203 or SEQ ID NO:s 229 to 373, their fragments, their complements, and sequences which hybridize to SEQ ID NO:s 1 to 203 or SEQ ID NO:s 229 to 373 under high stringency conditions and detecting the expression level of at least one of SEQ ID NO:s 1 to 203 or SEQ ID NO:s 229 to 373. For example, the polynucleotide can have 65% sequence identity, 75% sequence identity, 85% sequence identity, 95% sequence identity, 99% sequence identity, or be identical to the sequence or a fragment of the sequence. The invention also provides methods for altering ability of a plant to accumulate sugar by expressing or interfering with the expression of polypeptides having similarity to or comprising polypeptides encoded by SEQ ID NO:s 1 to 203 or SEQS ID NO:s 229 to 373 and detecting the expression level of at least one of the polypeptides encoded by SEQ ID NO:s 1 to 203 or SEQ ID NO:s 229 to 373. The similarity, for example, can be of 65%, 75%, 85%, 95%, 99%, or 100%. Typically, expression levels of polynucleotides and the encoded polypeptides are interfered with or decreased using anti-sense RNA or RNA interference methods.

In other embodiments, the invention provides transgenic plants produced by any method having altered expression of least one polynucleotide having sequence identity to or comprising SEQ ID NO:s 1 to 203 or SEQ ID NO:s 229 to 373, their fragments, their complements, and sequences which hybridize to SEQ ID NO:s 1 to 203 or SEQ ID NO:s 229 to 373 under high stringency conditions or having altered expression of polypeptides having sequence identity to or comprising a polypeptide encoded by SEQ ID NO:s 1 to 203 and SEQ ID NO:s 229 to 373. In still other embodiments, the invention provides transgenic plants produced by methods described above, using genes that express or interfere with the expression of least one polynucleotide having sequence identity to or comprising SEQ ID NO:s 1 to 203 or SEQ ID NO:s 229 to 373, their fragments, their complements, and sequences which hybridize to SEQ ID NO:s 1 to 203 or SEQ ID NO:s 229 to 373 under high stringency conditions or expressing polypeptides having similarity to or comprising polypeptides encoded by SEQ ID NO:s 1 to 203 or SEQ ID NO:s 229 to 373. Seeds, seed-canes (or setts) of such plants are also provided.

In yet another embodiment, the invention provides non-naturally occurring plants with altered expression levels generated by methods described above, such as mutagenesis. Seeds, seed-canes (or setts) of such plants are also provided.

The present invention identifies genes differentially expressed in sugarcane progenies and varieties with different sugar content. Comparative measures of mRNA for the genes in isolation or combined are indicative of sucrose content. Methods that measure transcript levels for the genes can be used to determine gene expression levels and can include cDNA microarrays, oligonucleotide arrays, quantitative PCR, northern blot or other hybridization techniques. Likewise, methods that measure the proteins encoded by the genes can also be used to characterize plants and progenies originating from traditional breeding programs or transgenic plants with the goal of identifying or selecting candidates that contain high sucrose content. Additionally, the genes can be directly used to increase plant sucrose content if they are introduced in the plant through the generation of a transgenic plant.

The cDNA microarray technology, quantitative PCR and northern blots were used to identify molecular markers associated to sucrose content. The procedures used were as described in Papini-Terzi et al, 2005 and Nogueira et al., 2003. The cDNA microarrays contain 5154 ESTs related to sugarcane signal transduction, stress responses, transcription, hormone signalling, metabolism and other functional categories. The plants analyzed derive (1) from an F3 progeny from multiple crossings among S. officinarum and S. spontaneum genotypes, (2) an F1 progeny from a crossing between the commercial varieties SP80-180 and SP80-4966, (3) an F1 progeny from a crossing between the commercial varieties SP80-144 and SP85-7215, (4) two varieties precocious and rich in sucrose production, SP91-1049 and SP94-3166 and (5) two varieties late and poor in sucrose production, SP83-2847 and SP89-1115. Sucrose producing tissues, also known as source tissues (herein leaf) and sucrose accumulating tissues, also known as sink tissues (herein internodes) were collected from field grown plants. Soluble sugar content (Brix) measures were made. Samples were collected from individual and pools of 7 or 8 plants. In some cases, samples were collected throughout the year. Three designs were used to perform transcriptome comparisons for the identification of genes differentially expressed when (I) High Sugar and Low Sugar plants were directly compared, (II) High Sugar and Low Sugar plants were compared to a common reference, or (III) High Sugar and Low Sugar internodes were compared. Experimental Design I and II yielded 208 differentially expressed genes, while Design III revealed 140 differentially expressed genes, totalling 348 genes differentially expressed in at least one of the samples analysed. Several differentially expressed genes were validated by real-time PCR and northern blots using individual plants as the source for tissues or groups of plants which proves that the differential expression is robust enough to distinguish between high and low sucrose plants in a pool of plants.

The gene profiles of one or a plurality of the 203 genes obtained from the comparisons of Design I may be useful as molecular markers for traditional breeding, aid in the selection of ideal progenies and parents generated in traditional breeding or aid in the selection of transgenic events generated in the process of transgenic plants production. The 348 genes themselves, identified in comparisons I, II and III, may be used in the generation of transgenic plants as they may directly function in sucrose synthesis and/or accumulation, be mutated by classical (non-transgenic) methods leading to varieties with improved sucrose content, or be used as probes in search of polymorphisms.

BRIEF DESCRIPTION OF THE FIGURES

FIG. 7—Alignment of nucleotide sequences for SEQ ID No. 411: CIPK-8 (SCEQLB2019B08.g); SEQ ID No. 412: CIPK-29 (SCSGHR10070F12.g); and SEQ ID No. 413: CIPK-1 (SCCCCL5001D11.g) using CLUSTALW (Thompson et al., 1994). The line above the sequences indicates the sequence fragment of 331 bp amplified and cloned in the plasmid in order to silence the CIPK-8 gene by RNA interference in the transgenic plants.

DEFINITIONS

Figure 1:
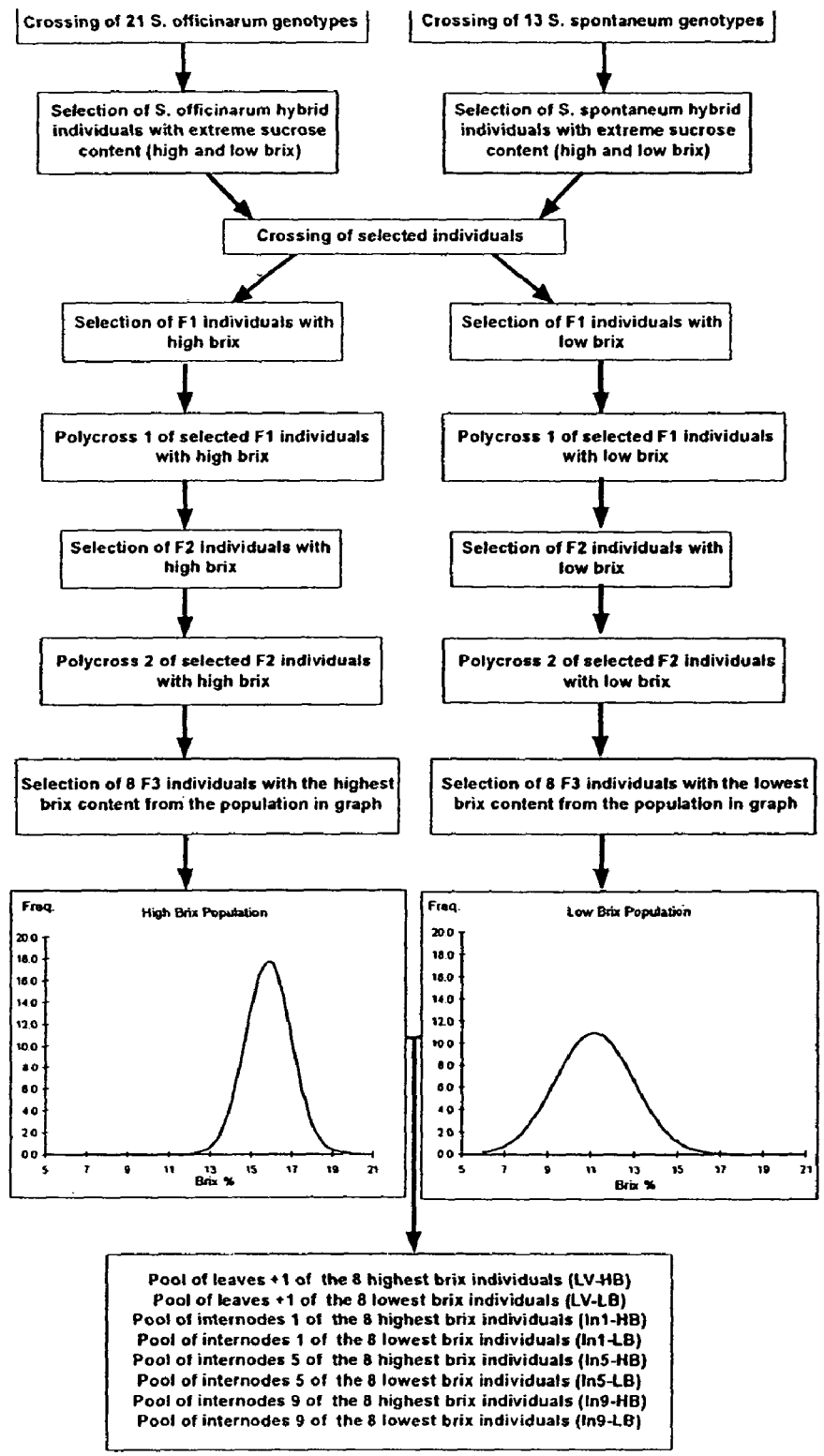
FIG. 1: Polycrosses performed among *S. officinarum* and *S. spontaneum* cultivars to obtain the sugarcane hybrid populations with high- and low sugar content. The graphs show the frequency of individuals from the F3 progeny corresponding to each of the Brix classes (Brix %). Brix was measured from juice of 500 individuals. Tissues of the 16 extreme individuals were collected and pooled for the microarray analysis. For real-time PCR quantification the RNA was extracted independently for each individual tissue.

The term "plants" include any plant amenable to transformation techniques, including angiosperms (monocotyledonous and dicotyledonous plants), gymnosperms, ferns, and multicellular algae. It includes plants of a variety of ploidy levels, including aneuploid, polyploid, diploid, haploid and hemizygous. The term "plant" includes whole plants, shoot vegetative organs/structures (e.g. leaves, stems and tubers), roots, flowers and floral organs/structures, seed (including embryo, endosperm, and seed coat) and fruit (the mature ovary), plant tissue (e.g. vascular tissue, ground tissue, and the like) and cells (e.g. guard cells, egg cells, trichomes and the like), and progeny of same. Examples of suitable plant targets would include but are not limited to Acadia, alfalfa, apple, apricot, *Arabidopsis*, artichoke, arugula, asparagus, avocado, banana, barley, beans, beet, blackberry, blueberry, broccoli, brussels sprouts, cabbage, canola, cantaloupe, carrot, cassaya, castorbean, cauliflower, celery, cherry, chicory, cilantro, citrus, clementines, clover, coconut, coffee, corn, cotton, cucumber, Douglas fir, eggplant, endive, escarole, eucalyptus, fennel, figs, garlic, gourd, grape, grapefruit, honey dew, jicama, kiwifruit, lettuce, Iceks, lemon, lime, Loblolly pine, linseed, mango, melon, mushroom, nectarine, nut, oat, oil palm, oil seed rape, okra, olive, onion, orange, an ornamental plant, palm, papaya, parsley, parsnip, pea, peach, peanut, pear, pepper, persimmon, pine, pineapple, plantain, plum, pomegranate, poplar, potato, pumpkin, quince, radiata pine, radiscchio, radish, rapeseed, raspberry, rice, rye, sorghum, Southern pine, soybean, spinach, squash, strawberry, sugarbeet, sugarcane, sunflower, sweet potato, sweetgum, tangerine, tea, tobacco, tomato, triticale, turf, turnip, a vine, watermelon, wheat, yams, and zucchini. Particularly preferred plant targets would include sugarcane and sugarbeet. More preferably the plant is a crop plant used to produce sucrose or that can be transformed into a sucrose producing plant. Further preferably, the plant is sugarcane.

The term "sugarcane plants" can be/or be derived from:

any *Saccharum* wild-type genotype (for example, *Saccharum officinarum, Saccharum spontaneum, Saccharum robustum*)

any genus that crosses with Saccharum (for example, *Miscanthus, Erianthus, Narenga, Sclerestachya*)

any sugarcane hybrid generated spontaneously any sugarcane hybrid generated by traditional breeding techniques any sugarcane progenies generated from crosses of wild-type or commercial varieties any sugarcane plant generated by the introduction of a transgene (transgenic plants)

The term "promoter" refers to regions or sequence located upstream and/or downstream from the start of transcription and which are involved in recognition and binding of RNA polymerase and other proteins to initiate transcription. A "plant promoter" is a promoter capable of initiating transcription in plant cells.

The term "seed-cane" (or setts) refers to stem cuttings or pieces of sugarcane stalk used to vegetatively propagate sugarcane cultures.

DETAILED DESCRIPTION OF INVENTION

Very little is known on the molecular mechanisms governing sucrose synthesis and accumulation in sugarcane. Although varieties exist capable of accumulating different amounts of sucrose, studies designed to compare these cultivars at the molecular level are scarce. The identification of genes conferring favourable traits to commercial hybrids is highly desirable for the sugarcane industry, since they could be used as markers for assisted selection.

The present invention broadly relates to defining a gene expression profile for SEQ ID NO. 1-203 that facilitates identification, isolation and characterization of high and low sucrose content sugarcane plants. The present invention also relates to defining a gene expression profile for SEQ ID NO:s 1-203 and SEQ ID NO:s 229-373 that is associated with sucrose content indicating genes that may be useful in the generation of sucrose enriched plants. Gene expression data can be determined for plants that can be a progeny derived from crossings (A), commercial varieties or cultivars (B), or transgenic plants (C).

With the purpose of selecting plants with high brix (soluble sugar content), a series of crossings involving *Saccharum officinarum* and *Saccharum spontaneum* genotypes were performed. First, intra-specific polycrosses were performed among 21 *Saccharum officinarum* genotypes and 13 *Saccharum spontaneum* genotypes (Table 1). Subsequently, the progenies of these independent crossings were evaluated for their sugar content and the most extreme individuals intercrossed. A series of recombination and selection events was promoted thereafter to select two populations with contrasting sugar accumulation capacities (FIG. 1). Eight genotypes with high brix (HB) content and eight with low brix (LB) were selected from the F3 progeny. In the context of the present invention, but not limited to, the brix difference ranges from 3 to 16. Table II shows the brix values for the sixteen individuals selected. Leaf+1 and internodes 1, 5 and 9 were collected. As used herein, leaf+1 is the first leaf with a visible dewlap and internodes are the plant parts above ground, with the exception of leaves. Tissues were pooled for HB and LB independently and total RNA was extracted.

TABLE I

*S. officinarum* and *S. spontaneum* genotypes used for the polycrosses.

| S. officinarum | S. spontaneum |
|---|---|
| Caiana Fita | IN8458 |
| IK76108 | IN8488 |
| Lahaina | Krakatau |
| MZ151 | SES 147b |
| MZ151 roxa | US56158 |
| Sabura | US7440 |
| Salangor | US851008 |
| Sinimbu | UM721 |
| NG213 | UM691 |
| Fiji 47 | SES 194 |
| Hinahina 18 | IK7686 |
| Manjri Red | US56193 |
| Muntok Java | US571723 |
| NG77142 | |
| Soff 8268 | |
| SS601 | |
| Sylva | |
| NG2880 | |
| Vae Vae Ula | |
| IJ76315 | |
| IN8425 | |

TABLE II

Brix measurements of the 16 individuals (genotypes) selected for gene expression profiling.

| Classification | Genotype | Brix |
|---|---|---|
| High Brix | CTC98-241 | 23.00 |
| | CTC98-242 | 23.90 |
| | CTC98-243 | 22.90 |
| | CTC98-244 | 23.40 |
| | CTC98-246 | 22.60 |
| | CTC98-252 | 22.20 |
| | CTC98-253 | 22.50 |
| | CTC98-258 | 22.10 |
| Low Brix | CTC98-261 | 8.60 |
| | CTC98-262 | 9.10 |
| | CTC98-265 | 9.10 |
| | CTC98-268 | 9.35 |
| | CTC98-271 | 10.60 |
| | CTC98-272 | 10.80 |
| | CTC98-277 | 10.60 |
| | CTC98-279 | 10.60 |

Figure 2:
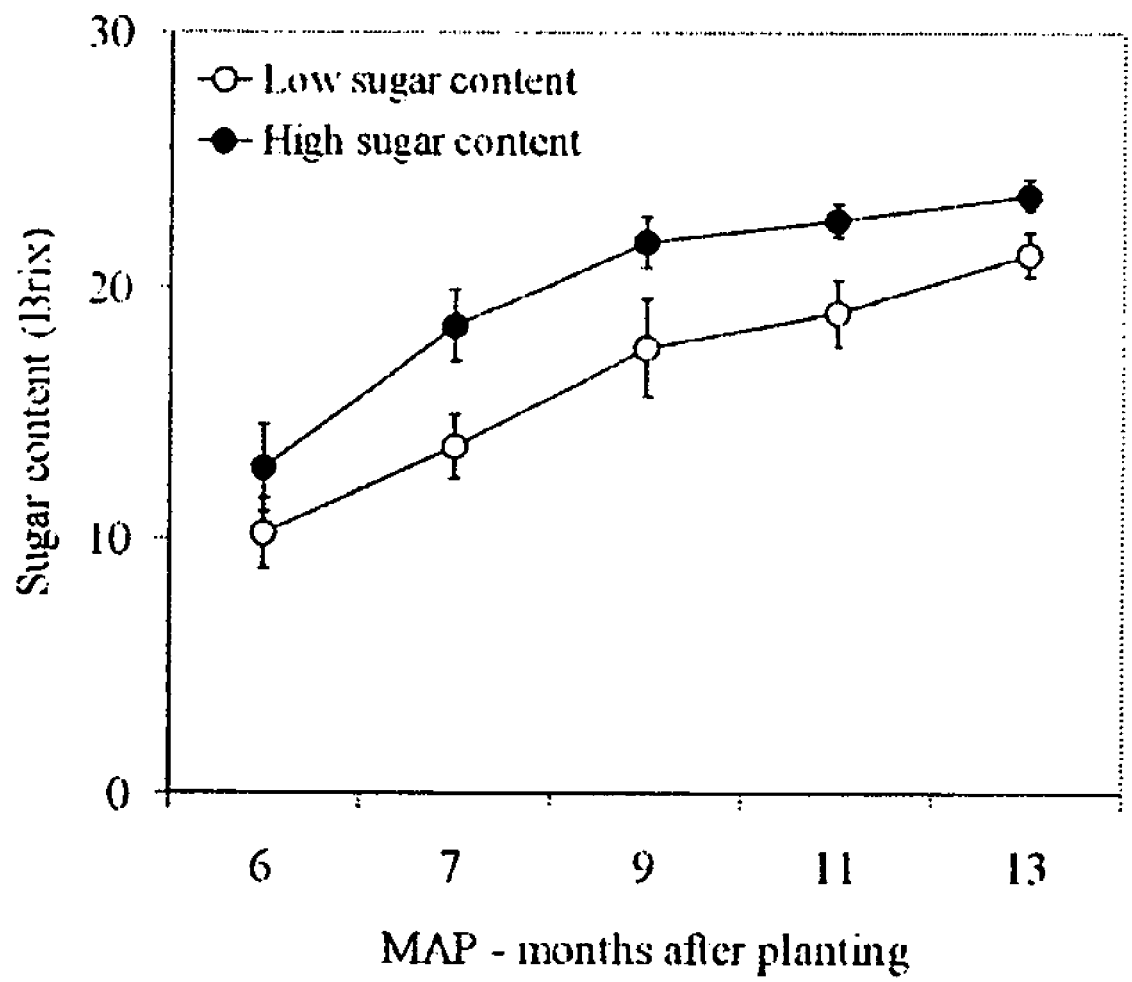
FIG. 2—Sugar content along the growing season in the extreme individuals of a sugarcane segregant population. The Brix (soluble solids) values of the most mature internode of each sugarcane segregant plant were measured along the growing season. Average Brix values and standard deviations of the seven individuals with the highest or lowest sugar contents are shown for the indicated times.

In a similar experiment, a field-grown F, progeny selected from a cross between the sugarcane varieties SP 80-180 and SP 80-4966 was characterized. From a total of 500 individuals, we picked out seven plants with the highest (7HB) and seven with the lowest (7LB) sugar content. FIG. 2 shows the average values and standard deviations for soluble solids level (Brix) of the most mature internode of these two groups of plants along the growing season (6, 7, 9, 11 and 13 months after planting).

Figure 6:
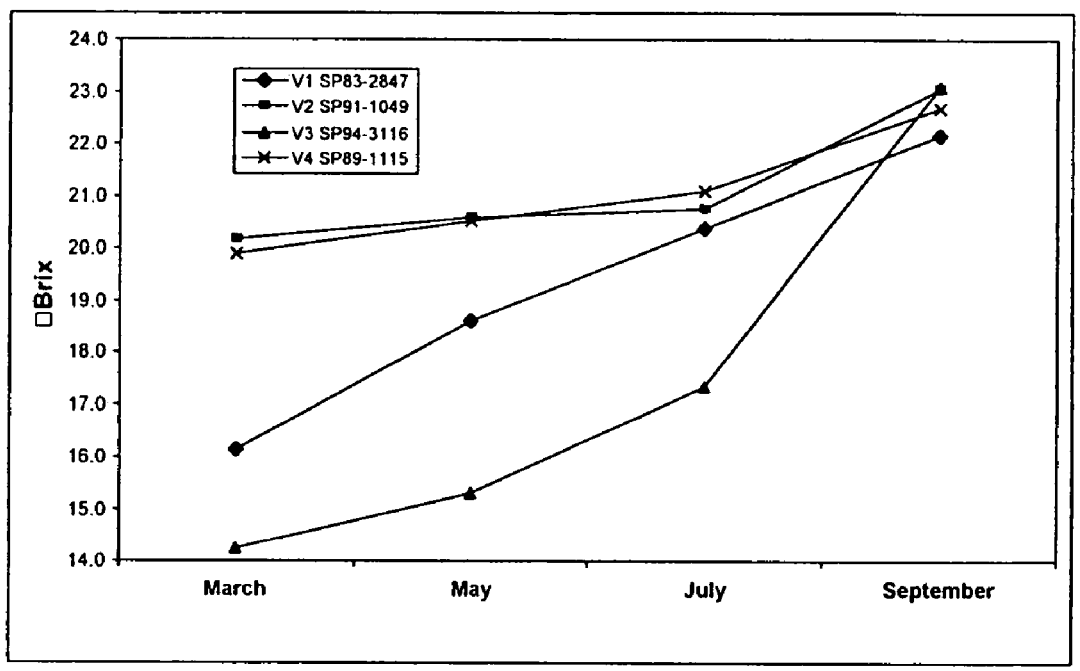
FIG. 6—Sugar content along the growing season in two sugarcane cultivars poor and late in sucrose accumulation (SP83-2847 and SP94-3116) and two sugarcane cultivars rich and precocious in sucrose accumulation (SP91-1049 and SP89-1115). The Brix (soluble solids) values of the most mature internode of each sugarcane segregant plant were measured during the growing season. Average Brix values and standard deviations are shown for the indicated times.

Additionally, the F1 progeny from a cross between the sugarcane varieties SP80-144 and SP85-7215 (selected as described for the cross between varieties SP 80-180 and SP 80-4966), two varieties precocious and rich in sucrose production (SP91-1049 and SP94-3166) and two varieties late and poor in sucrose production (SP83-2847 and SP89-1115) were also analysed. FIG. 6 shows the sugar content during the growing season in the two sugarcane cultivars poor and late in sucrose accumulation (SP83-2847 and SP94-3116) and the two sugarcane cultivars rich and precocious in sucrose accumulation (SP91-1049 and SP89-1115). For all of these, brix measures from field-grown plants were taken, leaf tissues were collected and total RNA was extracted. Table III lists all the progenies and varieties used in the present invention.

TABLE III

Sugarcane Progenies and varieties used for molecular marker identification

| Tissue | Plant Age | Origin of High Brix and Low Brix Plants |
|---|---|---|
| Internode 1 | 7 months | SP80-180 vs SP80-4966 progenies |
| Internode 5 | 7 months | SP80-180 vs SP80-4966 progenies |
| Internode 9 | 7 months | SP80-180 vs SP80-4966 progenies |
| Internode 1 | 11 months | SP80-180 vs SP80-4966 progenies |
| Internode 5 | 11 months | SP80-180 vs SP80-4966 progenies |
| Internode 9 | 11 months | SP80-180 vs SP80-4966 progenies |
| Internode 1 | 10 months | S. spontaneum vs S. officinarum progenies |
| Internode 5 | 10 months | S. spontaneum vs S. officinarum progenies |
| Internode 9 | 10 months | S. spontaneum vs S. officinarum progenies |
| Leaf | 10 months | SP80-144 vs SP85-7215 progenies |
| Leaf | 9 months | SP80-180 vs SP80-4966 progenies |
| Leaf | 10 months | S. spontaneum vs S. officinarum progenies |
| Leaf | 7 months | SP83-2847 varieties |
| Leaf | 7 months | SP91-1049 varieties |
| Leaf | 7 months | SP94-3116 varieties |
| Leaf | 7 months | SP89-1115 varieties |
| Leaf | 12 months | SP83-2847 variety |
| Leaf | 14 months | SP83-2847 variety |
| Leaf | 16 months | SP83-2847 variety |
| Leaf | 18 months | SP83-2847 variety |
| Internode 1 | 12 months | SP83-2847 variety |
| Internode 1 | 14 months | SP83-2847 variety |
| Internode 1 | 16 months | SP83-2847 variety |
| Internode 1 | 18 months | SP83-2847 variety |
| Leaf | 12 months | SP94-3116 variety |
| Leaf | 14 months | SP94-3116 variety |
| Leaf | 16 months | SP94-3116 variety |
| Leaf | 18 months | SP94-3116 variety |
| Internode 1 | 12 months | SP94-3116 variety |
| Internode 1 | 14 months | SP94-3116 variety |
| Internode 1 | 16 months | SP94-3116 variety |
| Internode 1 | 18 months | SP94-3116 variety |
| Leaf | 12 months | SP91-1049 variety |
| Leaf | 14 months | SP91-1049 variety |
| Leaf | 16 months | SP91-1049 variety |
| Leaf | 18 months | SP91-1049 variety |
| Internode 1 | 12 months | SP91-1049 variety |
| Internode 1 | 14 months | SP91-1049 variety |
| Internode 1 | 16 months | SP91-1049 variety |
| Internode 1 | 18 months | SP91-1049 variety |
| Leaf | 12 months | SP89-1115 variety |
| Leaf | 14 months | SP89-1115 variety |
| Leaf | 16 months | SP89-1115 variety |
| Leaf | 18 months | SP89-1115 variety |
| Internode 1 | 12 months | SP89-1115 variety |
| Internode 1 | 14 months | SP89-1115 variety |
| Internode 1 | 16 months | SP89-1115 variety |
| Internode 1 | 18 months | SP89-1115 variety |

In parallel, cDNA microarrays were constructed with PCR products derived from 1857 polynucleotides representing sugarcane genes from the cDNA libraries produced by the Sugarcane EST Consortium (SUCEST), providing a platform for comparisons of gene expression profile. Approximately half of all the signal transduction genes identified by the Sugarcane Signal Transduction (SUCAST) project are represented in these arrays (Papini-Terzi et al., 2005), as well as genes related to general metabolism, stress, pathogen responses and transcription. The HB (High Brix) and LB (Low Brix) samples from each progeny or variety tissue were compared by hybridizing to the arrayed genes. Two replicate hybridizations were made for each comparison with the dye-swapped in the second hybridization. To reveal molecular markers of brix content, hybridizations were done to compare a tissue from the high brix plant to the same tissue in a low brix plant (Design I). Also, two high brix varieties and two low brix varieties were compared (Design II) by performing hybridizations against a common reference composed of an equimolar mixture of RNA samples from all four cultivars. Two replicate hybridizations were made for each comparison with the dye-swapped in the second hybridization. Additionally, mature and intermediately mature internodes were compared to immature internodes from both the high brix and the low brix plants (Design III). Again, two replicate hybridizations were made for each comparison with the dye-swapped in the second hybridization. Data analysis was done essentially as described by Papini-Terzi et al. (2005). Briefly, cut-off limits that define "differential expression" were calculated based on "self-self" hybridizations (Vencio and Koide, 2005). To improve data reliability, only genes with at least 70% consistency in replicate experiments were considered differentially expressed. A total of 208 SAS (SEQ ID Nos 1-203) were found differentially expressed in at least one sample when tissues from HB and LB plants were contrasted. When mature and immature internodes were compared a total of 140 differentially expressed genes were identified (SEQ ID Nos 229 to 373). Tables IV and XIII list all of the ESTs corresponding to each SAS (sugarcane assembled sequence) predicted to correspond to the same transcript as assembled by the CAP3 program (Vettore et al., 2003) and the predicted assembled sequence. The ratio values for the microarray signals for each SAS in each sample is presented in Tables V to IX and Table XIV to XX. The tables also show the categories and gene functions for each sequence.

TABLE IV

List of Sugarcane Assembled Sequences (SAS) and their SEQ ID Nos.
The EST Genbank accession numbers are in parentheses. The SEQ ID No. refers to the sequence identifiers in the sequence listings. The listed ESTs assembled to the indicated sequence and should be considered one transcript. Each SAS is differentially expressed between plants with low and high sucrose content.

SEQ ID No. 1: SCAGFL1089G08.g
(CA199089, CA224271, CA224272)

SEQ ID No. 2: SCCCLR2C01G07.g
(CA185584, CA166776, CA134755, CA081538, CA166739, CA155955, CA084974, CA157742, CA270171, CA159531, CA187781, CA159517, CA089886, CA084049, CA159619, CA140397, CA087051, CA262468, CA159606, CA089976, CA183396, CA129456, CA066628, CA166690, CA140819, CA190385, CA187438, CA208612, CA190989, CA127354, CA140895, CA106597, CA158530, CA165616, CA157955, CA158357, CA163017, CA180366, CA156493, CA156721, CA110716, CA162841, CA088522)

SEQ ID No. 3: SCCCRZ1001C01.g
(CA186259, CA147312, CA107529, CA283111, CA275744, CA245497, CA240766, CA217267, CA129544, CA232142, CA186319, CA132949, CA266299, CA279493, CA239038, CA069036, CA279491, CA081552, CA172945, CA270762, CA214162, CA155441, CA208908, CA077560, CA094623, CA080165, CA281654, CA068431, CA080252, CA253608, CA280034, CA146798, CA149332, CA286419, CA149406, CA208282, CA168868, CA167581, CA247594, CA245731, CA264236, CA256980, CA196120, CA166139, CA256260, CA133068, CA216602, CA096037, CA133422, CA209478, CA172392, CA196703, CA148592, CA107794, CA078322, CA069441, CA262406, CA164639, CA117241, CA264263, CA272137, CA156857, CA275745, CA233167, CA073173, CA294936, CA096560, CA204575, CA190808, CA294814, CA134607, CA095396, CA294999, CA233246, CA279310, CA272172, CA121188, CA165918, CA087433, CA152584, CA163918, CA134688, CA260773, CA232223, CA134035, CA087517, CA078469, CA280895, CA147004, CA270846, CA285363, CA224721, CA300843, CA085545, CA193771, CA085617, CA152497, CA147851, CA234786, CA264280, CA190048, CA264249, CA259379, CA134846, CA284676, CA066363, CA148782, CA134929, CA094480, CA100929, CA128739, CA230006, CA257872, CA272842, CA153380, CA088481, CA199337, CA067318, CA120108, CA257959, CA068501, CA227954, CA156682, CA173310, CA064714)

SEQ ID No. 4: SCEQRT1033F01.g
(CA184995, CA156175, CA130817, CA186778, CA296253, CA162940, CA133313, CA185329, CA117474, CA186710, CA204874)

SEQ ID No. 5: SCEZLR1031G10.g
(CA175202, CA165752, CA167131, CA234178, CA121597, CA067987, CA118138, CA257467, CA098577)

SEQ ID No. 6: SCEZRZ1015G02.g
(CA237872, CA095197, CA148000, CA208159)

SEQ ID No. 7: SCJFRZ2014A03.g
(CA068448, CA182636, CA124874, CA151939)

SEQ ID No. 8: SCUTST3090E03.g
(CA187278, CA185355, CA180421, CA184313, CA210629)

SEQ ID No. 9: SCVPCL6042B11.g
(CA179030, CA079210, CA171761, CA167601, CA099889)

SEQ ID No. 10: SCVPFL3046C06.b
(CA244704, CA169357, CA226883, CA279223, CA226955, CA169444)

SEQ ID No. 11: SCACCL6008H06.g
(CA297327, CA096029, CA272424)

SEQ ID No. 12: SCACLR1036B06.g
(CA116282, CA208326, CA185586, CA161943, CA208173, CA164611, CA250322, CA141763, CA248417, CA173006, CA271344, CA248060, CA295677, CA141850, CA115167, CA150326, CA263624, CA155589, CA172473, CA210572, CA212977, CA071050, CA223263, CA183780, CA182338, CA123614, CA263704, CA258818, CA227706, CA185483, CA180358, CA227787, CA183645, CA183050, CA185991, CA164775, CA187002, CA167583, CA187440, CA294229, CA247569, CA268117, CA081801, CA175295, CA294155, CA231298, CA198645, CA181860, CA091352, CA203545, CA234600, CA163160, CA258992, CA211128, CA186109, CA173482, CA185124, CA194883, CA262166, CA280273, CA169398, CA224642, CA170802, CA208174, CA195079, CA169482, CA170947, CA170731, CA279502, CA170881, CA181104, CA206750, CA294040, CA171028, CA152678, CA257305, CA293976, CA213043, CA181646, CA187605, CA182139, CA143731, CA257402, CA193572, CA180425, CA297996, CA180830, CA283968, CA183965, CA213586, CA194480, CA086671, CA208319, CA075723, CA194663, CA293330, CA184108, CA075807, CA295739, CA168382, CA167495, CA212733, CA248494, CA187062, CA182290, CA181789, CA176860, CA201177, CA081385, CA122294, CA111436, CA181610, CA081463, CA081454, CA122407, CA172507, CA217801, CA112764, CA119200, CA205047, CA177228, CA168599, CA217883)

SEQ ID No. 13: SCACLR1126E09.g
(CA116458, CA129697, CA118229)

SEQ ID No. 14: SCACLR2007G02.g
(CA127563, CA091213, CA254488, CA091132, CA157102)

SEQ ID No. 15: SCACLR2014E12.g
(CA192165, CA154258, CA186575, CA158514, CA127675, CA104491, CA154264, CA097458, CA258945, CA164635, CA143359, CA186649, CA245697, CA113109, CA231117, CA271862)

SEQ ID No. 16: SCACSB1037A07.g
(CA167445, CA204908)

SEQ ID No. 17: SCAGAM2125C01.g
(CA082271)

SEQ ID No. 18: SCAGFL1089C03.g
(CA232431, CA214773, CA199044, CA226812, CA251426)

SEQ ID No. 19: SCAGLB1070E01.g
(CA111450, CA086189, CA214795, CA174551, BQ804015, CA174968, CA259932, CA072721, CA214876)

SEQ ID No. 20: SCAGLR1043E04.g
(CA139075, CA095747, CA163740, CA287933, CA254860, CA287205, CA276681, CA163825, CA158080, CA159744, CA166834, CA089831, CA146535, CA107721, CA159823, CA163282, CA101632, CA271953, CA112877, CA165306, CA116967, CA120230, CA165312, CA186064)

SEQ ID No. 21: SCAGLR1043F02.g
(CA290432, CA292969, CA279534, CA183060, CA183152, CA121646, CA096370, CA099981, CA192245, CA167424, CA214962, CA125300, CA267241, CA122577, CA246321, CA214857, CA261846, CA214921, CA120097, CA122234, CA158059, CA202210, CA273838, CA263626, CA205312, CA183023, CA263706, CA185079, CA116969, CA275126, CA184998)

TABLE IV-continued

List of Sugarcane Assembled Sequences (SAS) and their SEQ ID Nos.
The EST Genbank accession numbers are in parentheses. The SEQ ID No. refers to the sequence identifiers in the sequence listings. The listed ESTs assembled to the indicated sequence and should be considered one transcript. Each SAS is differentially expressed between plants with low and high sucrose content.

SEQ ID No. 22: SCAGLR2026G12.g
(CA282277, CA117544, CA173493, CA097993, CA123854,
CA277803, CA276657, CA163057, CA089417, CA123966,
CA150636, CA152810, CA105994, CA124675, CA095504,
CA260199, CA124712, CA288917, CA145237, CA165000,
CA167668, CA066913, CA161175, CA128073, CA128273,
CA157707, CA084376, CA143727, CA143896, CA146035,
CA159999, CA128260, CA123367, CA125688, CA111277,
CA081486, CA239639, CA159912, CA224751, CA135227,
CA277229, CA154488, CA114788, CA187359, CA183121,
CA137987, CA125112)

SEQ ID No. 23: SCAGSD2042G08.g
(CA301419, CA301408, CA282279, CA282268)

SEQ ID No. 24: SCBFFL4114B06.g
(CA254510)

SEQ ID No. 25: SCBFFL5074C09.g
(CA204004, CA293285, CA203956, CA244892, CA290019,
CA132334, CA244976, CA235410, CA292110, CA239336)

SEQ ID No. 26: SCBFLR1039B05.g
(CA072436, CA164922, CA219265, CA294041, CA087182,
CA086094, CA133140, CA082356, CA178376, CA150762,
CA091920, CA261338, CA155935, CA092012, CA084247,
CA074480, CA163545, CA163534, CA264111, CA188825,
CA079335, CA188476, CA087023, CA271843, CA164692,
CA161125, CA161569, CA186875, CA218879, CA147374,
CA086305, CA218962, CA247037, CA158661, CA089106,
CA089861, CA154471, CA172672, CA155677, CA157667,
CA240350, CA160822, CA085679, CA142367, CA067697,
CA078551, CA165453, CA193896, CA240083, CA159199,
CA117385, CA083799, CA184601, CA073646, CA087006,
CA067781, CA228606, CA157128, CA165295, CA164303,
CA090710, CA157426, CA218214, CA144877, CA082959,
CA082212, CA092766, CA218299, CA082071, CA082361,
CA166357, CA092479, CA155760, CA154412, CA157932,
CA080915, CA089329, CA155569, CA084631, CA084421,
CA163520, CA070855, CA267791, CA070926, CA083685,
CA193867, CA164257, CA262071, CA280355, CA253389,
CA151412, CA099704, CA099702, CA091852, CA103683,
CA218228, CA216440, CA076652, CA218313, CA081569,
CA147549, CA092093, CA092327, CA082854, CA160806,
CA234098, CA081072, CA155277, CA081503, CA156306,
CA228091, CA165593, CA084277, CA164984, CA085999)

SEQ ID No. 27: SCBFLR1060F03.g
(CA117505, CA090821, CA184876, CA102138)

SEQ ID No. 28: SCBFRZ2046D07.g
(CA150681, CA109085, CA179474, CA203314, CA174283)

SEQ ID No. 29: SCBFSB1046D04.g
(CA167835)

SEQ ID No. 30: SCBFSB1047C02.g
(CA170539, CA208192, CA167900, CA178739)

SEQ ID No. 31: SCBFST3136A06.g
(CA181757, CA181841, CA204913)

SEQ ID No. 32: SCBGLR1003D06.g
(CA222877, CA125433, CA148517, CA123170, CA124367,
CA229025, CA191858, CA150470, CA137422, CA242621,
CA067144, CA107570, CA077924, CA219677, CA117862,
CA137913, CA260601, CA189186, CA191192, CA103772,
CA149267, CA111228, CA149344, CA283660, CA154152,
CA153751, CA165134, CA177823, CA228650, CA287491,

TABLE IV-continued

List of Sugarcane Assembled Sequences (SAS) and their SEQ ID Nos.
The EST Genbank accession numbers are in parentheses. The SEQ ID No. refers to the sequence identifiers in the sequence listings. The listed ESTs assembled to the indicated sequence and should be considered one transcript. Each SAS is differentially expressed between plants with low and high sucrose content.

CA136728, CA162238, CA164661, CA139437, CA189271,
CA282312, CA121420, CA289514, CA134330, CA259414,
CA288712, CA148333, CA134387, CA221721, CA264749,
CA201139, CA113386, CA078385, CA115600, CA241752,
CA106360, CA118148, CA138627, CA190187, CA115438,
CA154012, CA150848, CA071918, CA226319, CA281964,
CA270512, CA146712, CA165133, CA078380, CA241934,
CA138140, CA115533, CA117783)

SEQ ID No. 33: SCBGLR1023D05.g
(CA193105, CA188272, CA224873, CA241264, CA300539,
CA188009, CA241339, CA241331, CA133005, CA150388,
CA079307, CA185891, CA079026, CA088897, CA116440,
CA073525, CA117725, CA286594)

SEQ ID No. 34: SCBGLR1096E06.g
(CA131852, CA136715, CA264334, CA198772, CA181655,
CA118258)

SEQ ID No. 35: SCBGLR1099G02.g
(CA118527, CA088599)

SEQ ID No. 36: SCBGLR1115D10.g
(CA236898, CA118948, CA290199, CA222803, CA247964,
CA241212, CA294776, CA213997, CA223503, CA223512,
CA241290, CA077364, CA223593, CA223583, CA228839,
CA237054, CA200849, CA200388, CA238984, CA077442,
CA079128, CA271913)

SEQ ID No. 37: SCCCAD1001C08.g
(CA213052, CA064626, CA208782)

SEQ ID No. 38: SCCCAD1004H02.g
(CA064903, CA065602, CA196686, CA068322)

SEQ ID No. 39: SCCCAM1001A03.g
(CA224922, CA097767, CA289761, CA293310, CA072765,
CA177152, CA082771, CA228990, CA200984, CA071379,
CA186832, CA174514, CA299571, CA285188, CA200732,
CA074444, CA070971, CA266681, CA292024)

SEQ ID No. 40: SCCCAM2004G02.g
(CA175137)

SEQ ID No. 41: SCCCAM2C04G08.g
(CA188572, CA081398, CA083085, CA177802, CA081466)

SEQ ID No. 42: SCCCCL3001F04.g
(CA090274, CA218633, CA271564, CA072795, CA176380,
CA212400, CA076605, CA292379, CA176809, CA261558,
CA092442, CA082952, CA171891, CA132285, CA298117,
CA136926, CA205249, CA244356, CA084659, CA174001,
CA220841, CA188161, CA262641, CA084625, CA147909,
CA258069, CA130594, CA268345, CA098011, CA297370,
CA147196, CA232960, CA072355, CA139295, CA103872,
CA161619, CA076646, CA192047, CA069119, CA269782,
CA176915, CA202483, CA147582, CA142782, CA077648,
CA092390, CA082458, CA266894, CA230599, CA129577,
CA192875, CA205406, CA195633, CA258918, CA239390,
CA195611, CA091961, CA211152, CA238101, CA082565,
CA261071, CA139562, CA238798, CA267286, CA126957,
CA112818, CA258847, CA097943, CA262159, CA170717,
CA070245, CA192180, CA167707, CA147514, CA176991,
CA076215, CA266294, CA071776, CA190170, CA261881,
CA082649, CA167116, CA200225, CA166545, CA174720,
CA180863, CA098735, CA078299, CA080135, CA137514,
CA084364, CA146987, CA130332, CA078373, CA215588,
CA179346, CA079412, CA147435, CA187943, CA179432,
CA179450, CA167646, CA117675, CA147627, CA279536,

TABLE IV-continued

List of Sugarcane Assembled Sequences (SAS) and their SEQ ID Nos.
The EST Genbank accession numbers are in parentheses. The SEQ ID No. refers to the sequence identifiers in the sequence listings. The listed ESTs assembled to the indicated sequence and should be considered one transcript. Each SAS is differentially expressed between plants with low and high sucrose content.

CA123234, CA251889, CA209472, CA094022, CA093214, CA235526, CA066029, CA291616, CA270178, CA088732, CA079067, CA210802, CA173849, CA208418, CA147384, CA249228, CA205005)

SEQ ID No. 43: SCCCCL3002C09.b
(CA164754, CA192507, CA149213, CA260796, CA187083, CA101050, CA232366, CA230776, CA285317, CA299708, CA232454, CA168679, CA122474, CA179836, CA117294, CA122512, CA123772, CA254900, CA183002, CA127885, CA168911, CA071983, CA236670, CA266142, CA109668, CA168996, CA094485, CA273741, CA182273, CA300109, CA259484, CA109752, CA266217, CA095537, CA105282, CA190305, CA273812, CA095612, CA174112, CA102333, CA222873, CA241526, CA234235, CA169388, CA138129, CA247699, CA259138, CA169473, CA189915, CA232514, CA174741, CA221599, CA174821, CA195129, CA205165, CA136996, CA078205, CA189405, CA235587, CA098138, CA116327, CA114878, CA191259, CA300967, CA191089, CA235666, CA183278, CA145262, CA137898, CA156970, CA121379, CA095453, CA134465, CA138724, CA129675, CA134544, CA174648, CA123308, CA137470, CA228406, CA125187, CA179729, CA145327, CA179613, CA116680, CA134096, CA185020, CA097986, CA241590, CA120065, CA098133, CA300763, CA248222, CA114920, CA140135, CA260971, CA206920, CA069768, CA135583, CA241001, CA126239, CA254670, CA104750, CA225281, CA205773, CA158716, CA177253, CA135668, CA069844, CA176685, CA104833, CA179725, CA175015, CA093273, CA156663, CA144277, CA077356, CA139207, CA077433, CA156162, CA233672, CA289617, CA136244, CA092631, CA121367, CA166600, CA285273, CA096245, CA174136, CA131526, CA127387, CA243490, CA107152, CA130718, CA234183, CA139986, CA242827, CA295952, CA127931, CA130008, CA134095, CA138704, CA083624, CA291487, CA217158, CA140705, CA176381, CA300124, CA225694, CA269792, CA142766, CA244765, CA072024, CA208843, CA140774, CA142408, CA244840, CA240123, CA294166, CA131496, CA242966, CA183794, CA078230, CA294108, CA171510, CA070363, CA084393, CA243058, CA238566, CA130322, CA275283, CA149534, CA070447, CA086950, CA275350, CA145273, CA103468, CA186854, CA101246, CA127499, CA113173, CA255273, CA228952, CA180533, CA188382, CA280222, CA179960, CA145293, CA205177, CA301035, CA127828)

SEQ ID No. 44: SCCCCL3080A11.b
(CA195011, CA186362, CA296480, CA296654, CA275397, CA290669, CA282198, CA221529, CA275467, CA135001, CA167417, CA290056, CA148875, CA076391, CA242540, CA141300, CA287167, CA076476, CA176410, CA080697, CA252988, CA184697, CA242340, CA200871, CA179297, CA253071, CA185063, CA159627, CA284239, CA185199, CA159286, CA291109, CA179461, CA248226, CA086290, CA176240, CA191934, CA245914, CA278165, CA103412, CA152746, CA230916, CA245835, CA242649, CA230990, CA132349, CA287873, CA166292, CA273797, CA160174, CA274023, CA122335, CA273788, CA092884, CA091203, CA154817, CA276231, CA136820, CA287241, CA207749, CA276377, CA066806, CA122402, CA159765, CA276035, CA296496, CA279832, CA271356, CA091503, CA215068, CA129109, CA116743, CA121331, CA290328, CA285668, CA287690, CA232825, CA069961, CA076390, CA101186, CA240902, CA180980, CA076475, CA226125, CA283780, CA283709, CA159661, CA182917, CA202160, CA065119, CA155633, CA218498, CA217558, CA288910, CA130058, CA169110, CA249436, CA190722, CA282286, CA169189, CA149394, CA176923, CA148689, CA123410, CA197169, CA174886, CA202258, CA181623, CA153982, CA263764,

TABLE IV-continued

List of Sugarcane Assembled Sequences (SAS) and their SEQ ID Nos.
The EST Genbank accession numbers are in parentheses. The SEQ ID No. refers to the sequence identifiers in the sequence listings. The listed ESTs assembled to the indicated sequence and should be considered one transcript. Each SAS is differentially expressed between plants with low and high sucrose content.

CA274086, CA111644, CA093560, CA273768, CA112839, CA093040, CA065124, CA137999, CA264537)

SEQ ID No. 45: SCCCCL3120C09.g
(CA164701, CA224926, CA093647, CA083169, CA111541, CA083168, CA093732, CA122320, CA265053, CA157947, CA122415, CA122420, CA273041, CA164238, CA130292, CA121753, CA161184, CA087082, CA090483, CA072914)

SEQ ID No. 46: SCCCCL3120G07.g
(CA126728, CA185585, CA206387, CA125243, CA265002, CA185315, CA245734, CA180717, CA067294, CA091012, CA181272, CA244870, CA264526, CA106164, CA199596, CA180607, CA236822, CA104054, CA244956, CA125117, CA180803, CA067314, CA104139, CA224603, CA279337, CA099590, CA142258, CA168155, CA094223, CA266351, CA180794, CA231617, CA209380, CA093688, CA125829, CA187261, CA187424, CA261208, CA067342, CA226296, CA189470, CA067295, CA168751, CA090956, CA184722, CA178676, CA211245, CA239943, CA107492)

SEQ ID No. 47: SCCCCL4002E02.g
(CA116501, CA215472, CA157057, CA272126, CA132749, CA282608, CA185323, CA134724, CA131522, CA298731, CA172476, CA093967, CA157851, CA177663, CA265966, CA164160, CA157052, CA145182, CA184790, CA069776, CA222319, CA156078, CA190828, CA140192, CA133240, CA211567, CA166155, CA067205, CA195541, CA091963, CA172143, CA089803, CA163027, CA090747, CA191514, CA139123, CA162363, CA225047; CA109794)

SEQ ID No. 48: SCCCCL4005F05.g
(CA280584, CA301445, CA101272, CA094199, CA251241, CA287651, CA277095, CA217700)

SEQ ID No. 49: SCCCCL6002B05.g
(CA235513, CA140487, CA095693, CA183575, CA187535, CA270075, CA259493, CA262265, CA181192, CA279039)

SEQ ID No. 50: SCCCCL6003D08.g
(CA261317, CA207685, CA249487, CA295361, CA295292, CA176975, CA249563, CA259708, CA096709)

SEQ ID No. 51: SCCCFL4094H12.g
(CA235328, CA253578)

SEQ ID No. 52: SCCCLB1001D03.g
(CA070103, CA233451, CA280144, CA161397, CA073973, CA246052, CA266278, CA187448, CA087616, CA105439, CA292489, CA289895, CA251852, CA112903, CA217956, CA110778, CA193638, CA079528, CA109891, CA157072)

SEQ ID No. 53: SCCCLB1003E11.g
(CA183789, CA280103, CA133961, CA139899, CA070532, CA110960, CA153393, CA133885, CA263460, CA115969, CA153912, CA115964, CA271209, CA135793, CA271124, CA186641, CA170726, CA186568)

SEQ ID No. 54: SCCCLR1001A06.g
(CA190346, CA248924, CA092763, CA083592, CA188740, CA077113, CA116115, CA158015, CA121535, CA204604, CA216472, CA105973)

SEQ ID No. 55: SCCCLR1001E04.g
(CA286692, CA185203, CA283556, CA297496, CA283763, CA107947, CA281797, CA273397, CA288055, CA182167, CA272567, CA275912, CA115183, CA261160, CA169335, CA275587, CA116155, CA276409, CA275516, CA113912, CA180802, CA281743, CA169255, CA275068, CA283676,

TABLE IV-continued

List of Sugarcane Assembled Sequences (SAS) and their SEQ ID Nos.
The EST Genbank accession numbers are in parentheses. The SEQ ID No. refers to the sequence identifiers in the sequence listings. The listed ESTs assembled to the indicated sequence and should be considered one transcript. Each SAS is differentially expressed between plants with low and high sucrose content.

CA274801, CA185414, CA288928, CA297998, CA276051,
CA247335, CA278026, CA276440, CA295185, CA110175,
CA182175, CA281251, CA287476, CA277138, CA277597,
CA281255, CA277512, CA170522, CA282815, CA216931,
CA208645, CA208714, CA117824, CA119303, CA295245,
CA210512, CA297891, CA180801, CA284125, CA275675,
CA301424, CA285422, CA182158, CA286170, CA182550,
CA284723, CA286095, CA282404, CA274292, CA183110)

SEQ ID No. 56: SCCCLR1022B11.g
(CA262370, CA175573, CA283139, CA282225, CA175736,
CA098979, CA274092, CA283705, CA234778, CA090105,
CA291719, CA234765, CA149808, CA156650, CA184954,
CA162473, CA165344, CA283982, CA145397, CA227663,
CA217233, CA193153, CA098173, CA170572, CA168929,
CA133676, CA119647, CA096824, CA169015, CA181636,
CA176861, CA108797, CA095801, CA102799, CA168953,
CA142627, CA140623, CA150372, CA211448, CA065362,
CA283916, CA262588, CA296130, CA137717, CA144579,
CA281526, CA097927, CA260822, CA178228, CA099128,
CA192194, CA301126, CA135072, CA179839, CA150376,
CA234766, CA297660, CA281655, CA176409, CA273865,
CA297545, CA284140, CA297734, CA098177, CA073430,
CA259653, CA136165, CA135273, CA153599, CA181778,
CA282925, CA153678, CA070825, CA144282, CA296412,
CA097932)

SEQ ID No. 57: SCCCLR1022F10.g
(CA233639, CA260053, CA185523, CA222669, CA095561,
CA167708, CA222802, CA278697, CA175743, CA221789,
CA121319, CA177308, CA299149, CA273209, CA244627,
CA215981, CA178001, CA066057, CA244686, CA234654,
CA297895, CA179682, CA207766, CA186315, CA194047,
CA233580, CA186380, CA269743, CA186727, CA179261,
CA186798, CA146095, CA229185, CA239458, CA240513,
CA221284, CA118249, CA276970, CA253631, CA163389,
CA194377, CA184587, CA138682, CA083453, CA186061,
CA168226, CA289825, CA261002, CA279246, CA099796,
CA254874, CA222389, CA269896, CA133477, CA221786,
CA298984, CA256819, CA167056, CA181465, CA164471,
CA222384, CA178907, CA244604, CA118336, CA266032,
CA118095, CA084230, CA280986, CA258373, CA266089,
CA250738, CA193208, CA122349, CA185474, CA119690,
CA175851, CA103705, CA099948, CA299982, CA276941,
CA298487, CA148104, CA187876, CA107311, CA066053,
CA273213, CA137497, CA222054, CA182618, CA244395,
CA273241, CA244475, CA257856, CA205271, CA085415,
CA192092, CA097961)

SEQ ID No. 58: SCCCLR1024A02.g
(CA177199, CA178859, CA148547, CA271595, CA165098,
CA191796, CA284535, CA119371, CA257923, CA284457,
CA139287)

SEQ ID No. 59: SCCCLR1024C03.g
(CA214530, CA092678, CA259139, CA119392, CA138689,
CA142234, CA110468, CA166793, CA235001, CA239014,
CA187582, CA153171, CA166778, CA229316, CA108240,
CA142532, CA231084, CA122112, CA249179, CA267413,
CA116485, CA188769, CA130021, CA193695, CA073718,
CA205841, CA183536, CA161063, CA206262, CA235000,
CA190341, CA202723, CA090059, CA090058, CA236017,
CA082031, CA187867, CA155918, CA103108, CA070579,
CA079479, CA110879, CA119822)

SEQ ID No. 60: SCCCLR1048D07.g
(CA147475, CA291066, CA096819, CA204869, CA181487,
CA192930, CA209156, CA067272, CA147995, CA244339,
CA180480, CA171800, CA284134, CA196820, CA244421,

TABLE IV-continued

List of Sugarcane Assembled Sequences (SAS) and their SEQ ID Nos.
The EST Genbank accession numbers are in parentheses. The SEQ ID No. refers to the sequence identifiers in the sequence listings. The listed ESTs assembled to the indicated sequence and should be considered one transcript. Each SAS is differentially expressed between plants with low and high sucrose content.

CA243578, CA182300, CA186405, CA186430, CA283235,
CA179955, CA184880, CA186482, CA145597, CA186507,
CA208666, CA197511, CA175966, CA145686, CA256333,
CA204958, CA209389, CA101793, CA101156, CA221552,
CA181039, CA166999, CA180658, CA256408, CA253875,
CA192877, CA197390, CA166969, CA093997, CA240271,
CA205247, CA182628, CA181383, CA099255, CA146394,
CA070562, CA213081, CA185160, CA070652, CA070769,
CA180031, CA291102, CA170929, CA204905, CA132911,
CA218801, CA134618, CA171253, CA206709, CA167078,
CA222191, CA134393, CA244769, CA298008, CA133579,
CA140427, CA221930, CA171805, CA147956, CA145072,
CA115358, CA168857, CA145152, CA221551, CA254585,
CA222208, CA193664, CA168945, CA135732, CA106240,
CA288063, CA067331, CA105045, CA182416, CA253889,
CA267756, CA211247, CA197638, CA122733, CA220849,
CA217920, CA217294, CA159483, CA267841, CA122809,
CA064754, CA168537, CA205015, CA217367, CA212148,
CA195018, CA141826, CA173132, CA185041, CA152829,
CA183112, CA222487, CA066599, CA244066, CA165764,
CA096242, CA207168, CA187102, CA121886, CA172779,
CA232513, CA221622, CA163385, CA187635, CA165823,
CA108173, CA216201, CA196736, CA145978, CA253253,
CA143737, CA220822, CA066971, CA137693, CA192288,
CA169323, CA149105, CA235200, CA133460, CA231421,
CA256401, CA155413, CA115687, CA231501, CA065787,
CA066028, CA130814, CA166921, CA195510, CA065872,
CA119495, CA211215, CA234020, CA097049, CA110451,
CA219727, CA130446, CA107579, CA104154, CA170754,
CA169355, CA138200, CA167435, CA192429, CA190819,
CA138088, CA170937, CA187379, CA222270, CA169442,
CA256336, CA171875, CA289972, CA204877, CA133091,
CA253873, CA146649, CA171683, CA174259, CA182738,
CA180326, CA146716, CA132203, CA157422, CA192841,
CA257875, CA180828, CA157372, CA234853, CA112786,
CA181526, CA205074, CA186020, CA194299, CA217863,
CA185113, CA211872, CA121463, CA133052, CA173016,
CA068878, CA195370, CA170626, CA070371, CA216657,
CA068962, CA243574, CA171193, CA216340, CA297779,
CA182680, CA067729, CA180065, CA207908, CA067811,
CA180150)

SEQ ID No. 61: SCCCLR1048F03.g
(CA127113, CA065075, CA127212, CA277499, CA129554,
CA121603, CA121408, CA125178, CA127440, CA276807,
CA126903, CA283043, CA236098, CA097364, CA118155,
CA281809, CA070362, CA297080, CA278048, CA121485,
CA301525, CA116435, CA120637, CA284860, CA277432,
CA276771, CA189482, CA124010, CA276938, CA120532,
CA288405, CA122385, CA276469, CA215504, CA065010,
CA275948, CA126086, CA208335, CA209295, CA210653,
CA126762, CA219057, CA127157, CA072321, CA125785,
CA206577, CA190063, CA284449, CA070651, CA285051,
CA065024, CA120482, CA117975, CA208190, CA129193,
CA289201, CA168876, CA289063, CA096730, CA128766,
CA282961, CA189708, CA285413, CA067943, CA275056,
CA065005, CA274114, CA276236, CA067075, CA126585,
CA126946, CA193276, CA177371, CA286524, CA281416,
CA176878, CA301261, CA120733, CA267336, CA190241,
CA119190, CA297298, CA116632, CA117265, CA276973,
CA125066, CA119744, CA227317, CA279870, CA124816,
CA285933, CA121585, CA212660, CA173116, CA125319,
CA282719, CA212404, CA284489, CA066031, CA285534,
CA285189, CA118289, CA284558, CA119511, CA274189,
CA065095, CA129555, CA283138, CA283217, CA285867,
CA124018, CA281823, CA296966, CA288144, CA123645,
CA126639, CA278851, CA297029, CA117985, CA296567,
CA195886, CA068236, CA219344, CA065081, CA208255,
CA129812, CA296642, CA126079, CA068319, CA129203,

TABLE IV-continued

List of Sugarcane Assembled Sequences (SAS) and their SEQ ID Nos.
The EST Genbank accession numbers are in parentheses. The SEQ ID No. refers to the sequence identifiers in the sequence listings. The listed ESTs assembled to the indicated sequence and should be considered one transcript. Each SAS is differentially expressed between plants with low and high sucrose content.

CA125738, CA276707, CA194608, CA282969, CA122439, CA122553, CA276334, CA281049, CA281213, CA208478, CA265249)

SEQ ID No. 62: SCCCLR1065F03.g
(CA119768, CA180227)

SEQ ID No. 63: SCCCLR1066G08.g
(CA130183, CA119863, CA190094, CA189956, CA118906, CA129694)

SEQ ID No. 64: SCCCLR1068D03.g
(CA131141, CA282509, CA101490, CA156675, CA119997, CA266674, CA131210, CA107609, CA265499)

SEQ ID No. 65: SCCCLR1C02F07.g
(CA288961, CA273685, CA256939, CA112913, CA107999, CA276603, CA241855, CA085479, CA193799, CA252891, CA097052, CA257482, CA203818, CA239070, CA266548, CA099488, CA252672, CA202292, CA279439, CA187630, CA298704, CA125723, CA251524, CA179558, CA177714, CA119975, CA276149, CA128085, CA264406, CA124059, CA247506, CA246266, CA222791, CA100437, CA252417, CA189608, CA225806)

SEQ ID No. 66: SCCCLR1C03G01.g
(CA114535, CA287070, CA203793, CA113049, CA227918, CA143767, CA239356, CA111397, CA177088, CA130728, CA189457, CA164190, CA236768, CA141069, CA122177, CA110741, CA276010, CA072413, CA272629, CA174772, CA256494, CA077651, CA269728, CA178457, CA115111, CA287055, CA126217, CA193225, CA178389, CA247689, CA228551, CA138141, CA227995, CA286643, CA189695, CA256499, CA228805, CA106329, CA202331, CA141201, CA142188, CA123003, CA256606, CA097345, CA167647, CA290389, CA154610, CA081435, CA256686, CA126629, CA115110, CA151805, CA081363, CA167055, CA235116, CA133295, CA148899, CA173127, CA099540, CA148811, CA192344, CA235424, CA272042, CA147268)

SEQ ID No. 67: SCCCLR1C03H09.g
(CA194061, CA211639, CA280503, CA116278, CA077744, CA211491, CA209038, CA100317, CA072278, CA096295, CA132466, CA250830, CA292901, CA255776, CA065950, CA160220, CA106513, CA097514, CA098595, CA104618, CA131327, CA119740, CA264663, CA299848, CA218570, CA183289, CA097825, CA158831, CA135080, CA100314, CA132712, CA100433, CA193691, CA138566, CA103770, CA189715, CA160835, CA134464, CA167292, CA196381, CA172852, CA155853, CA084870, CA180963, CA155411, CA156712, CA154796, CA139279, CA163490, CA284118, CA156681, CA110548, CA248342, CA208017, CA169428, CA233919, CA204384, CA295171, CA179262, CA275173, CA100318, CA272098, CA196446, CA244403, CA220478, CA210201, CA218571, CA117867, CA096983, CA132497, CA122468, CA251047, CA136481, CA138022, CA211494, CA190471, CA175863, CA209234, CA143825, CA133828, CA067734, CA180756, CA137429, CA103045, CA100994, CA068413, CA234182, CA227939, CA263768, CA273411, CA205106)

SEQ ID No. 68: SCCCLR1C04C02.g
(CA125668, CA125865, CA189739, CA125492)

SEQ ID No. 69: SCCCLR1C04G08.g
(CA244725, CA238883, CA238483, CA199706, CA117832, CA204153, CA261571, CA167779, CA176803, CA189784, CA193796, CA276132)

SEQ ID No. 70: SCCCLR1C05B03.g
(CA143788, CA143875, CA143787, CA143708, CA101128, CA143785, CA157761, CA250652, CA185977, CA183646, CA120887, CA189812, CA287301)

SEQ ID No. 71: SCCCLR1C05B07.g
(CA165238, CA208083, CA066000, CA126133, CA201529, CA116306, CA122356, CA295947, CA160571, CA120466, CA122884, CA211355, CA071582, CA264046, CA155655, CA085182, CA225540, CA066152, CA122081, CA177997, CA176532, CA071498, CA221498, CA171047, CA279593, CA189816, CA242630, CA092278, CA125314, CA170969, CA281472, CA081806, CA160840, CA272348, CA233103, CA204708, CA280170, CA198137, CA233033, CA118959, CA165234, CA086800, CA123824, CA258260, CA128698, CA140416, CA284775, CA201691, CA192826, CA189953, CA132444, CA198335, CA091105, CA091933, CA201610, CA121611, CA207356, CA259590)

SEQ ID No. 72: SCCCLR1C05G07.g
(CA297138, CA290571, CA262529, CA220559, CA204203, CA069404, CA115586, CA193158, CA121039, CA174217, CA115870, CA174293, CA104946, CA274619, CA220266, CA142369, CA242315, CA160721, CA158160, CA210774, CA218047, CA233747, CA278657, CA128109, CA152442, CA184091, CA100098, CA097713, CA103537, CA217191, CA196904, CA274571, CA272485, CA069076, CA196586, CA261588, CA142478, CA202565, CA108110, CA084880, CA257882, CA229994, CA196659, CA066247, CA133689, CA297542, CA173977, CA182109, CA202628, CA230076, CA086869, CA219503, CA073403, CA098116, CA173463, CA204754, CA186033, CA233775, CA101254, CA214205, CA095524, CA069310, CA128718, CA069189, CA203720, CA243929, CA287679, CA284184, CA262863, CA261604, CA123605, CA119184, CA284257, CA202222, CA119783, CA196568, CA259819, CA172217, CA196643, CA068643, CA104586, CA271898, CA222538, CA091523, CA264674, CA193641, CA104655, CA132878, CA125332, CA156254, CA069514, CA300556, CA176289, CA070284, CA189868, CA070369, CA195256, CA147140, CA089091, CA234689, CA066214, CA067046, CA192673, CA269296, CA243676, CA067124, CA264162, CA263530, CA160302, CA157527, CA207879, CA249440, CA104497, CA193097, CA104395, CA294629, CA117002, CA104480, CA211739, CA261852, CA126214, CA108276, CA099770, CA111230, CA166005, CA254045, CA132264, CA268441, CA132728, CA290796, CA173401, CA196261, CA272490, CA233980, CA260947, CA193010, CA225272, CA290862, CA252690, CA070750, CA114221, CA070826, CA066738, CA172334, CA229793, CA267884, CA224989, CA207706, CA229890, CA156552, CA192222, CA190669, CA160369, CA275764, CA066572, CA216926, CA165930, CA244384, CA291738, CA223497, CA286984, CA178039, CA244462, CA208957, CA240296, CA067855, CA263436, CA181579, CA223577, CA146490, CA249333, CA185057, CA201456, CA211242, CA144460, CA157071, CA193340, CA097777, CA194601, CA214431, CA098121, CA295608, CA127853, CA138257, CA138018, CA218660, CA141681, CA221859, CA218738, CA185406, CA197336, CA100940, CA197241, CA284997, CA291940, CA159153, CA240718, CA215992, CA225524, CA210365, CA159221, CA264160, CA235294, CA159304, CA248608, CA186071, CA211758, CA069425, CA110260, CA072797, CA105702, CA120991, CA100099, CA105781, CA244089, CA266283, CA208917, CA177938, CA167214, CA181492, CA146602, CA065458, CA183802, CA295110, CA183809, CA104306, CA227708, CA183876, CA267695, CA181557, CA158128, CA104378, CA267781, CA183921, CA227789, CA147775, CA262173, CA147225, CA164441, CA186580, CA300171, CA264964, CA166300, CA186652, CA204896,

TABLE IV-continued

List of Sugarcane Assembled Sequences (SAS) and their SEQ ID Nos.
The EST Genbank accession numbers are in parentheses. The SEQ ID No. refers to the sequence identifiers in the sequence listings. The listed ESTs assembled to the indicated sequence and should be considered one transcript. Each SAS is differentially expressed between plants with low and high sucrose content.

CA285255, CA226022, CA217982, CA224315, CA105942, CA158616, CA297551, CA117447, CA220364, CA168851, CA276987, CA190237, CA106022, CA116056, CA264622, CA184486, CA271818, CA168430, CA189345, CA233898, CA172815, CA155992, CA206379, CA166234, CA187152, CA212298, CA099983, CA204961, CA273020, CA169701, CA284310, CA180342, CA064888, CA183975, CA284388, CA262319, CA186021, CA248789, CA262273, CA282426, CA177536, CA248866, CA212699, CA110479, CA176162, CA144804, CA141216, CA275881, CA176238, CA184086, CA141296, CA224239, CA204895, CA276923, CA197046, CA221422, CA068719, CA068789, CA144258, CA183632, CA130681, CA136685, CA184391, CA112468, CA183495, CA103881, CA211815, CA204894, CA293260, CA099929, CA094118, CA284494, CA254873, CA135620, CA190021, CA284622, CA192812, CA135705, CA068304, CA103086, CA155097, CA173863, CA068377, CA110653, CA255712, CA209951, CA185502, CA278212, CA117995, CA255796, CA168934, CA098017, CA219302, CA257679, CA169019, CA278196, CA105166, CA101795, CA087846, CA193447, CA270003, CA105242, CA191196, CA266313, CA288753, CA257281, CA282991, CA096227, CA068749, CA197855, CA065529, CA222362, CA243507, CA068817, CA065600, CA118181, CA068718, CA238905, CA273579, CA213371, CA166910, CA185022, CA122534, CA158024, CA068788, CA070547, CA065590, CA064671, CA183774, CA164793, CA119888, CA091778, CA202473, CA082838, CA138229, CA099466, CA191901, CA124125, CA164484, CA261289, CA243775, CA172637, CA253160, CA067154, CA172720, CA097408, CA160296, CA253234, CA273519, CA067231, CA129930, CA097192, CA126132, CA126108, CA127189, CA295338, CA206463, CA067398, CA099677, CA097714, CA124424, CA294414, CA180655, CA294483, CA268542, CA211287, CA168728, CA268608, CA147090, CA117060, CA297065, CA193107, CA195812)

SEQ ID No. 73: SCCCLR1C08G10.g
(CA242767, CA121427, CA190110, CA265913, CA256539, CA230257)

SEQ ID No. 74: SCCCLR2001H09.g
(CA296017, CA073224, CA150710, CA161861, CA275518, CA121510, CA236217, CA121324, CA106856, CA275589, CA105456, CA186919, CA115199, CA072158, CA105535, CA198312, CA279139, CA267315, CA088244, CA228873, CA199179, CA117254, CA110928, CA120536, CA172530, CA188752, CA127047, CA079583, CA114477, CA074802, CA236212, CA208088, CA074878, CA214679, CA152717, CA292362, CA109321, CA121262, CA236850, CA257917, CA109407, CA131450, CA170188, CA117821, CA249112, CA073701, CA165055, CA280305)

SEQ ID No. 75: SCCCLR2002E04.g
(CA189063, CA103400, CA105310, CA257545, CA074280, CA081249, CA225565, CA111480, CA200578, CA205658, CA172577, CA107282, CA203202, CA110134, CA086789, CA075665, CA119351, CA175412, CA278217, CA262185, CA289641, CA297337, CA178188, CA110401, CA071940, CA256334, CA073443, CA271459, CA114734, CA214806, CA277079, CA150950, CA112857, CA201428, CA190220, CA290653, CA189454, CA115238, CA127110, CA112237, CA300604, CA178184, CA129133, CA178175, CA286335, CA212524, CA213221, CA223367, CA077677, CA210694, CA251136, CA223442, CA255159, CA124471, CA104032, CA206849, CA200562, CA278797, CA278234, CA121278, CA295565, CA207628, CA249525, CA091812, CA187657, CA216232, CA124525, CA177704, CA211004, CA238405, CA220308)

TABLE IV-continued

List of Sugarcane Assembled Sequences (SAS) and their SEQ ID Nos.
The EST Genbank accession numbers are in parentheses. The SEQ ID No. refers to the sequence identifiers in the sequence listings. The listed ESTs assembled to the indicated sequence and should be considered one transcript. Each SAS is differentially expressed between plants with low and high sucrose content.

SEQ ID No. 76: SCCCLR2002F08.g
(CA211650, CA110492, CA148400, CA300475, CA150508, CA150497, CA300102, CA300257, CA095819, CA104906, CA091149, CA153754, CA258870, CA269965, CA297954, CA065422, CA174959, CA194403, CA106313, CA139292, CA248471, CA282371, CA168458, CA300988, CA166296, CA067041, CA288473, CA180947, CA067119, CA065892, CA162857, CA272827, CA296238, CA274958, CA114610, CA273634, CA127125, CA260192, CA300615, CA285686, CA152730, CA082206, CA105905, CA285436, CA070842, CA218583, CA168512, CA070916, CA101647, CA295802, CA211573, CA262162, CA132706, CA287764, CA285726, CA272603, CA196573, CA273889, CA105900, CA296728, CA262057, CA162541, CA064764, CA297035, CA297113, CA225722, CA125625, CA281507, CA129167, CA288837, CA106118, CA287900, CA177953, CA124483, CA128800, CA218582, CA276318, CA287392, CA278517, CA218499, CA218007, CA299081, CA295773, CA207196, CA145252, CA150651, CA261878, CA107256, CA155204, CA155181, CA296047, CA085447, CA127248, CA171611, CA300905, CA274697, CA184257, CA278069, CA275866, CA070109, CA141467, CA070191, CA152802, CA287858, CA190605, CA154302, CA199564, CA283532, CA209584, CA296251, CA291158, CA064871, CA102133, CA275969, CA141502, CA275504, CA141819, CA275580, CA106944, CA120936, CA150645, CA118413, CA274736, CA296185, CA223170, CA208553, CA283624, CA067879, CA107873, CA264649, CA288282, CA138280, CA148571, CA276218, CA260193)

SEQ ID No. 77: SCCCLR2002H11.g
(CA127148, CA113376, CA090822, CA175277, CA144706, CA191342, CA249121, CA112140)

SEQ ID No. 78: SCCCLR2003E10.g
(CA261916, CA072670, CA127180, CA082686, CA098222, CA072679, CA227230, CA230364, CA102583, CA131720)

SEQ ID No. 79: SCCCLR2C01F06.g
(CA125903, CA130165, CA127342, CA123725)

SEQ ID No. 80: SCCCLR2C02A05.g
(CA116671, CA130253)

SEQ ID No. 81: SCCCLR2C02D03.g
(CA262689, CA083750, CA101533, CA177058, CA236874, CA100362, CA128908, CA171906, CA102805, CA115056, CA127401, CA146627, CA158448, CA098804, CA146619, CA258980, CA215587, CA265819, CA265880, CA212035, CA261941, CA071913, CA267912, CA154469, CA079309, CA174463, CA118147, CA146622, CA273451, CA117370, CA267710, CA188407, CA122342)

SEQ ID No. 82: SCCCRT1001E01.g
(CA145556, CA265124, CA140467, CA259428, CA269652, CA132841, CA253363, CA298816, CA258474, CA265609, CA240255, CA185830, CA130669, CA139431, CA130399, CA260672, CA138292, CA218105, CA266538, CA269994, CA218177, CA258974, CA145910, CA190685, CA221999, CA190860, CA259945, CA080912, CA278886, CA264789, CA145914, CA107290, CA273194, CA260082, CA137145, CA265723, CA145474, CA131856, CA265716)

SEQ ID No. 83: SCCCRT2002G11.g
(CA098113, CA259292, CA167710, CA160985, CA167765, CA277212, CA301138, CA252372, CA264993, CA166058, CA174697, CA080916, CA298478, CA108271, CA213368, CA173993, CA211356, CA158908, CA162533, CA194961, CA184093, CA096644, CA161001, CA300513, CA144742, CA229700, CA266477, CA092549, CA193396, CA197153,

TABLE IV-continued

List of Sugarcane Assembled Sequences (SAS) and their SEQ ID Nos.
The EST Genbank accession numbers are in parentheses. The SEQ ID No. refers to the sequence identifiers in the sequence listings. The listed ESTs assembled to the indicated sequence and should be considered one transcript. Each SAS is differentially expressed between plants with low and high sucrose content.

CA096270, CA267077, CA174874, CA298338, CA158349, CA214804, CA136971, CA263769, CA225513, CA214883, CA157020, CA263846, CA281339, CA164770, CA160919, CA203458, CA290101, CA161006, CA114942, CA289802, CA195261, CA298479, CA198016, CA197064, CA298238, CA171959, CA172546, CA273048, CA299633, CA137199, CA156278, CA160900, CA194153, CA265809, CA160988, CA247104, CA174172, CA265871, CA191620, CA198789, CA175182, CA141419, CA174246, CA256737, CA123842, CA171971, CA172544, CA109630, CA163657, CA174143, CA256660, CA217966, CA109716, CA268027, CA157316, CA295099)

SEQ ID No. 84: SCCCRZ1001F02.g
(CA103948, CA150083, CA259661, CA300458, CA260819, CA115748, CA132394, CA139574, CA150333, CA137265, CA174881, CA276459, CA187808, CA162788, CA225541, CA236121, CA272799, CA143215, CA086510, CA126049, CA140320, CA190692, CA214128, CA293279, CA232739, CA288829, CA232827, CA205598, CA154561, CA258276, CA137338, CA285532, CA128190, CA142456, CA201134, CA132162, CA228245, CA126555, CA071690, CA209954, CA143470, CA248359, CA200342, CA115266, CA136159, CA207491, CA279420, CA272494, CA229717, CA287861, CA289897, CA292215, CA288557, CA123136, CA106015, CA109649, CA124195, CA256039, CA106083, CA259023, CA109734, CA182936, CA146835, CA267500, CA260093, CA161128, CA213896, CA260715, CA247923, CA260696, CA232980, CA235230, CA161214, CA233046, CA183253, CA106339, CA205597, CA226389, CA213070, CA085049, CA118942, CA065078, CA265611, CA065008, CA284023)

SEQ ID No. 85: SCCCRZ1001H05.g
(CA145736, CA287892, CA192135, CA146862, CA234792, CA101303, CA204402, CA151180, CA119789, CA288119, CA151262, CA080448, CA145653, CA095725)

SEQ ID No. 86: SCCCRZ1002E08.g
(CA179035, CA191340, CA233483, CA300253, CA085975, CA269763, CA262601, CA236263, CA070203, CA086063, CA190618, CA085969, CA300380, CA120960, CA294874, CA180727, CA292085, CA301489, CA086058, CA273085, CA131694, CA285350, CA182564, CA244750, CA238660, CA244829, CA243124, CA180028, CA144527, CA228073, CA159113, CA260317, CA161623, CA185003, CA184781, CA101457, CA136411, CA287945, CA269808, CA299418, CA142515, CA174197, CA128767, CA268523, CA174275, CA282823, CA146924, CA251224, CA172558, CA131340, CA200210, CA228169, CA184495, CA201598, CA178951, CA130651, CA183353)

SEQ ID No. 87: SCCCRZ1002H08.g
(CA279826, CA135036, CA124184, CA076729, CA240511, CA076725, CA146959, CA291640, CA146710, CA066324, CA122936, CA203952, CA156670, CA162985, CA245296, CA278468, CA117478, CA184525, CA207771, CA116304, CA240781)

SEQ ID No. 88: SCCCRZ1004H12.g
(CA216874, CA081561, CA106731, CA251585, CA066538, CA114810, CA148014, CA114649, CA267565, CA267650, CA088912, CA149128, CA227151, CA105454, CA125437, CA269856, CA187518, CA066036, CA286910, CA265042, CA234010, CA160780, CA185108, CA149229, CA110623, CA264544, CA095591, CA150496, CA111584, CA176699, CA140671, CA108165, CA123092, CA283700, CA287402, CA167981, CA064988, CA275544, CA177425, CA141224, CA275615, CA211803, CA125932, CA212296, CA141306, CA191643, CA140689, CA279161, CA079659, CA240039, CA159148, CA174083, CA067685, CA198561, CA143599, CA267523, CA097307, CA067769, CA267610, CA101896, CA096607, CA124965, CA248186, CA124435, CA108814, CA134608, CA192137, CA108989, CA134689, CA166683, CA094488, CA291849, CA109073, CA153798, CA147144, CA299990, CA173707, CA267553, CA225467, CA273321, CA110109, CA267638, CA104185, CA161871, CA290349, CA270432, CA163555, CA154762, CA222553, CA270296, CA166573, CA108407, CA182036, CA164299, CA202506, CA075284, CA225393, CA277703, CA202590, CA102086, CA110611, CA065056, CA233782, CA197286, CA229575, CA277050, CA157909, CA277094, CA140749, CA137396, CA196896, CA282885, CA239918, CA301434, CA196962, CA164275, CA084201, CA275533, CA145361, CA234812, CA275603, CA081143, CA186963, CA195293, CA131246, CA163061, CA180624, CA120533, CA181897, CA192846, CA159009, CA067687, CA225503, CA193928, CA170449, CA067771, CA156228, CA157265)

SEQ ID No. 89: SCCCRZ2001A10.g
(CA083266, CA170546, CA213983, CA240546, CA214055, CA068172, CA243400, CA112026, CA159624, CA178417, CA149593, CA195353)

SEQ ID No. 90: SCCCRZ2001E12.g
(CA220407, CA069786, CA266584, CA117131, CA149640, CA102694, CA107051, CA126788, CA178629, CA116298, CA189528)

SEQ ID No. 91: SCCCRZ2003E12.g
(CA290451, CA171106, CA257067, CA126312, CA285909, CA191695, CA175249, CA277181, CA198875, CA264876, CA228763, CA257385, CA149818, CA268790, CA228758, CA239922, CA147478)

SEQ ID No. 92: SCCCRZ2C01F09.g
(CA238345, CA110244, CA292133, CA226215, CA290161, CA089133, CA225941, CA087675, CA081960, CA263629, CA263709, CA271851, CA098120, CA103239, CA241010, CA081617, CA127228, CA241092, CA249515, CA289050, CA081621, CA285377, CA149903, CA084191, CA237910, CA287616, CA170459, CA180444, CA241705, CA072646, CA198212, CA140343, CA074071, CA260574, CA275241, CA219063, CA230826, CA216366, CA284463, CA231731, CA275313, CA277199, CA284538, CA085114, CA146451, CA238575, CA170457, CA241499, CA276966, CA150000, CA194018, CA282348, CA151656, CA292177, CA151735, CA081964, CA276948, CA281247, CA148593, CA127998, CA297924, CA098115, CA225142, CA104406)

SEQ ID No. 93: SCCCSD1003E02.g
(CA284001, CA285612, CA291203, CA278558, CA277223, CA285546, CA272455, CA284812, CA288109, CA285276, CA274083, CA274097, CA282761, CA284853, CA282957, CA276485, CA288135, CA282680, CA287028, CA288317, CA301448, CA281013, CA278500, CA287354)

SEQ ID No. 94: SCCCSD1092A08.g
(CA284222, CA275878, CA276919, CA284291, CA284297, CA281361, CA273485, CA285647, CA286280, CA287406)

SEQ ID No. 95: SCCCSD2001E05.g
(CA282080, CA282487, CA278050, CA284383, CA274256)

SEQ ID No. 96: SCCCSD2C03G12.g
(CA301232, CA297876, CA297283)

TABLE IV-continued

List of Sugarcane Assembled Sequences (SAS) and their SEQ ID Nos.
The EST Genbank accession numbers are in parentheses. The SEQ ID No. refers to the sequence identifiers in the sequence listings. The listed ESTs assembled to the indicated sequence and should be considered one transcript. Each SAS is differentially expressed between plants with low and high sucrose content.

SEQ ID No. 97: SCCCST1001C04.g
(CA096261, CA241976, CA265094, CA217159, CA169670, CA085862, CA103281, CA236141, CA230822, CA166981, CA178741, CA173538)

SEQ ID No. 98: SCCCST1006B11.g
(CA211361, CA070492, CA219037, CA070499, CA178358, CA173923, CA217421, CA217710)

SEQ ID No. 99: SCCCST3001H12.g
(CA182157, CA090806, CA135450, CA192177, CA157038, CA180203, CA186190, CA185139, CA088464, CA107032, CA186187)

SEQ ID No. 100: SCEPAM1020A03.g
(CA298761, CA238039, CA072781, CA202979, CA265514, CA203056, CA216879, CA274267, CA154767, CA072753, CA232137, CA272619)

SEQ ID No. 101: SCEPLR1030B03.g
(CA284018, CA296786, CA191311, CA135484, CA132970, CA260298, CA293358, CA232052, CA145338, CA296858, CA300403, CA289136, CA190455, CA256928, CA276730, CA114900, CA151879, CA131612, CA285822, CA281761, CA277035, CA131569, CA256849, CA139403, CA120776, CA111640, CA144584, CA109836, CA163350, CA103723, CA138138)

SEQ ID No. 102: SCEPLR1030E06.g
(CA120812, CA166500, CA121058, CA157792, CA147349)

SEQ ID No. 103: SCEPRZ1008F02.g
(CA084261, CA147347, CA090873, CA152001, CA234969, CA091560, CA150615, CA253916, CA204783, CA205748, CA192626, CA201996, CA202076, CA280863, CA162916, CA088703, CA085702, CA175387, CA269587, CA152933, CA092690, CA229677, CA152922, CA200559, CA156055, CA170331, CA140801, CA256055, CA152711, CA153264, CA199353, CA091994, CA151595, CA221404, CA153337, CA198274, CA151680, CA273193, CA214750, CA249251, CA084265, CA113829)

SEQ ID No. 104: SCEPRZ1010E06.g
(CA153095, CA171009, CA300383, CA134779, CA147516, CA171086, CA290145, CA187047, CA190622, CA249955, CA131632, CA285405, CA195540, CA146683, CA255486, CA274214, CA143354, CA262861, CA250035, CA196569, CA205156, CA196644, CA296007, CA172028, CA184943, CA117936, CA257643)

SEQ ID No. 105: SCEPRZ3087C08.g
(CA160294, CA160210)

SEQ ID No. 106: SCEQLB2019B08.g
(CA279976, CA272048)

SEQ ID No. 107: SCEQLR1007G03.g
(CA140431, CA259456, CA211527, CA271749, CA266277, CA141614, CA215266, CA220502, CA201033, CA142803, CA094784, CA172036, CA107212, CA194369, CA295096, CA065513, CA157629, CA181854, CA099236, CA296097, CA068795, CA145592, CA157045, CA169225, CA195900, CA289800, CA083770, CA103698, CA196336, CA066685, CA279318, CA134272, CA169306, CA144849, CA173189, CA190898, CA206313, CA176452, CA257180, CA084874, CA101125, CA249765, CA284335, CA162053, CA180997, CA197651, CA143812, CA188901, CA194298, CA234171, CA085641, CA267721, CA123786, CA267873, CA139542, CA208084, CA097722, CA158840, CA103745, CA232413, CA177068, CA138787, CA200611, CA183259, CA094119, CA293858, CA299758, CA232497, CA181726, CA207021, CA270176, CA077309, CA123096, CA142484, CA251020, CA205516, CA074457, CA144233, CA130849, CA171502, CA136847, CA265729, CA120240, CA192591, CA265372, CA195921, CA209672, CA125513, CA192394, CA259229, CA293855, CA105693, CA081981, CA131054, CA269628, CA146587, CA088333, CA158446, CA258765, CA134005, CA143367, CA258108, CA068778, CA271982, CA101526, CA227906, CA127817, CA117772, CA107439, CA088988, CA300259, CA135337, CA213654, CA190891, CA182017, CA120975, CA092302, CA202807, CA094566, CA274758, CA082503, CA094014, CA237917, CA089634, CA194363, CA089726, CA084158, CA145586, CA125521, CA142320, CA234258, CA229530, CA293659, CA300521, CA109689, CA191974, CA081639, CA294851, CA109766, CA074622, CA198332, CA200961, CA187329, CA281641, CA066256, CA299442, CA264175, CA121806, CA266806, CA241746, CA215496, CA255625, CA234149, CA068777, CA195842, CA178628, CA178717, CA142335, CA109521, CA148397, CA094810, CA096159, CA269632, CA077723, CA134029, CA094404, CA198903, CA294206, CA169711, CA181781, CA168554, CA079807, CA198035, CA071310, CA086691, CA180555, CA193559, CA203910, CA100811, CA085634, CA076712, CA069456, CA263383, CA280255, CA176816, CA066414, CA212509, CA167475, CA295033, CA194573, CA071797, CA076495, CA148279, CA101133, CA186819, CA180647, CA187603, CA198759, CA235563, CA291664, CA204052, CA284342, CA102950, CA118149, CA085453, CA085470, CA097975, CA183735, CA264115, CA198176)

SEQ ID No. 108: SCEQLR1091A10.g
(CA114539, CA257837, CA077076, CA262215, CA274238, CA211402, CA274108, CA230959, CA121144, CA256388, CA288382, CA079882, CA230878, CA241079, CA256311, CA237783, CA240995, CA073200, CA235765, CA113590, CA126147, CA077764, CA118720, CA123712, CA286990, CA281182, CA111839, CA124521, CA077641, CA255256, CA111725, CA129312, CA216352, CA209624, CA111908, CA155939, CA189115, CA135189, CA235762, CA291159, CA238370)

SEQ ID No. 109: SCEQRT1024B02.g
(CA216940, CA225607, CA179965, CA204515, CA132482, CA185736)

SEQ ID No. 110: SCEQRT1024E12.g
(CA295147, CA260615, CA254686, CA132523, CA197622, CA204899, CA190453, CA212246, CA197604, CA270758, CA270346, CA130936, CA269290, CA256715, CA132252, CA182867, CA107713, CA256638, CA258402, CA217358, CA184651, CA109919, CA185468, CA217428, CA156179, CA220042, CA109994, CA284009, CA214271, CA139017, CA135234, CA260181, CA234511, CA161112, CA102825, CA183055, CA103445, CA192331, CA107252, CA161202, CA288819, CA107320, CA258917, CA244198, CA220062, CA259939, CA069469, CA244275, CA220141, CA185728, CA284013)

SEQ ID No. 111: SCEQRT1025D04.g
(CA210404, CA217344, CA296134, CA217415, CA187015)

SEQ ID No. 112: SCEQRT1025D06.g
(CA132593, CA141785, CA141018, CA215251)

SEQ ID No. 113: SCEQRT1026H08.g
(CA145460, CA069364, CA140129, CA250315, CA145544, CA141404, CA293054, CA282922, CA163907, CA261070, CA163990, CA205321, CA173746, CA283810, CA134025,

TABLE IV-continued

List of Sugarcane Assembled Sequences (SAS) and their SEQ ID Nos.
The EST Genbank accession numbers are in parentheses. The SEQ ID No. refers to the sequence identifiers in the sequence listings. The listed ESTs assembled to the indicated sequence and should be considered one transcript. Each SAS is differentially expressed between plants with low and high sucrose content.

CA170490, CA240108, CA069401, CA280554, CA277690, CA168030, CA240167, CA222954, CA132730, CA217518, CA277435, CA191682, CA190599, CA133625, CA264946, CA277153, CA070912, CA217975, CA146562, CA284169, CA143199, CA087655, CA287350, CA273405, CA084518, CA301511, CA143266, CA290482)

SEQ ID No. 114: SCEQRT1028C03.g
(CA139365, CA286665, CA260598, CA139023, CA285888, CA274666, CA137906, CA281362, CA285687, CA136311, CA141788, CA103170, CA133136, CA269938, CA284682, CA288527, CA14870, CA285073, CA285465, CA284318, CA287456, CA130761, CA137490, CA144380, CA297849, CA131873, CA143782, CA281126, CA143182, CA191432, CA284091, CA278152, CA164514, CA139044, CA138535, CA283285, CA106682, CA102643, CA136156, CA132845, CA276716, CA275759, CA284563, CA268586, CA268592, CA143781, CA268641, CA284432, CA273135, CA139564, CA297995, CA268645, CA287370, CA143142, CA138952, CA143227, CA297005, CA101363, CA142135, CA115501, CA278630, CA138496, CA101781, CA286567, CA141623, CA136320, CA136240, CA288341, CA288312, CA104716, CA288071, CA193582, CA130778, CA297953, CA104799, CA143442, CA274724, CA104459, CA104545, CA274625, CA290645, CA278030, CA275085, CA138291, CA145190, CA144775, CA290713, CA133241, CA141076, CA272524, CA146265, CA293757, CA135230, CA139625, CA277500, CA131620, CA269954, CA131757, CA106126, CA268581, CA273592, CA106187, CA136999, CA288204, CA277749, CA143039, CA278287, CA139806)

SEQ ID No. 115: SCEQRT1031D02.g
(CA074042, CA088825, CA075266, CA271676, CA295638, CA133114, CA268786, CA112006, CA291853, CA269112, CA089768, CA292656, CA273097, CA078197, CA073875, CA074037, CA189360, CA260450)

SEQ ID No. 116: SCEQRT1033H06.g
(CA101392, CA115952, CA155650, CA133340, CA213648, CA215953, CA108139, CA102933, CA163612)

SEQ ID No. 117: SCEQRT2098H06.g
(CA172591, CA163271, CA229649, CA139483)

SEQ ID No. 118: SCEQRT2099H01.g
(CA086208, CA264357, CA086287, CA080644, CA266323, CA161194, CA300091, CA287964, CA221671, CA131618, CA251982, CA221152, CA159591, CA221951, CA156418, CA240390, CA161187, CA159676, CA139559, CA077881, CA161261, CA110139, CA077863)

SEQ ID No. 119: SCEQRT2100B02.g
(CA217945, CA139573, CA204327, CA260706, CA204248, CA269222, CA269284)

SEQ ID No. 120: SCEQRZ3020C02.g
(CA250725, CA161134, CA165966, CA160060, CA156919, CA164968, CA251491, CA069428)

SEQ ID No. 121: SCEZAM2058E08.g
(CA188635, CA183792, CA195687, CA084907, CA081270, CA081191, CA173384)

SEQ ID No. 122: SCEZHR1047A01.g
(CA103161, CA101776)

SEQ ID No. 123: SCEZHR1087F06.g
(CA253395, CA197374, CA287472, CA103877, CA278023)

SEQ ID No. 124: SCEZHR1088E02.g
(CA301005, CA296733, CA247972, CA103945, CA243569, CA251930)

SEQ ID No. 125: SCEZLB1009A09.g
(CA281626, CA244568, CA116483, CA237705, CA298353, CA298000, CA113117, CA284416, CA277289, CA284348, CA276706, CA290833, CA203091, CA101727, CA176398, CA132760, CA096672, CA290760, CA282167)

SEQ ID No. 126: SCEZLB1010E10.g
(CA111286, CA201293, CA292534, CA113224, CA078624)

SEQ ID No. 127: SCEZLB1012F10.g
(CA174564, CA069051, CA216445, CA163915, CA198521, CA068371, CA296305, CA113392, CA099142, CA163996, CA166390, CA116217, CA210122, CA074493, CA114992, CA275989)

SEQ ID No. 128: SCEZLR1052E07.g
(CA121650, CA116831, CA120886)

SEQ ID No. 129: SCEZRZ3098G10.g
(CA296471, CA160526, CA273318, CA275478, CA283208, CA160609, CA285866, CA277278, CA158745, CA283693, CA285324, CA285071, CA284153, CA274955, CA285128, CA297181, CA278664, CA272542, CA273750, CA294380, CA287923, CA273821, CA294450, CA297756, CA274726, CA296701, CA277926, CA296395, CA286712, CA286723, CA286722, CA275718, CA275927, CA283291, CA275408)

SEQ ID No. 130: SCEZST3147A10.g
(CA194007, CA182656)

SEQ ID No. 131: SCJFFL3C03C02.g
(CA230214, CA230128, CA229489)

SEQ ID No. 132: SCJFLR1035E04.g
(CA086527, CA195068, CA069060, CA083548, CA295865, CA177350, CA177349, CA277098, CA276954, CA155838, CA197797, CA244043, CA088503, CA121818, CA080812, CA155548, CA078754, CA089206, CA163208, CA129874, CA211416, CA276961, CA144131, CA158866, CA155542, CA199612, CA263981)

SEQ ID No. 133: SCJFLR1074E09.g
(CA262344, CA266655, CA176711, CA133325, CA122163, CA131810, CA082004, CA181680, CA180565, CA078933, CA085138, CA210263, CA210980, CA184457, CA262635, CA176142, CA234269, CA176141, CA178297, CA183158, CA082635, CA082991, CA198762, CA190715, CA190706, CA274415, CA081600, CA279078, CA181928, CA081942, CA267908, CA089450, CA084567, CA186427, CA078935)

SEQ ID No. 134: SCJFRT1005C11.g
(CA177520, CA225223, CA166003, CA253319, CA171361, CA209379, CA270001, CA185425, CA155754, CA167026, CA270006, CA106095, CA213061, CA170199, CA287881, CA132140, CA204757, CA155038, CA133369, CA254157, CA280727, CA260033, CA146511, CA186031, CA161879, CA296036, CA220424, CA220423, CA102390, CA184239)

SEQ ID No. 135: SCJFRT1007E01.g
(CA267659, CA267574, CA259232, CA265484, CA145383, SCJLLB2077E09.b)

SEQ ID No. 136: SCJFRT1007H07.g
(CA232046, CA260877, CA092783, CA231963, CA204189, CA133468, CA244788, CA244787, CA254691, CA244858,

TABLE IV-continued

List of Sugarcane Assembled Sequences (SAS) and their SEQ ID Nos.
The EST Genbank accession numbers are in parentheses. The SEQ ID No. refers to the sequence identifiers in the sequence listings. The listed ESTs assembled to the indicated sequence and should be considered one transcript. Each SAS is differentially expressed between plants with low and high sucrose content.

CA204513, CA230346, CA256769, CA108120, CA089835, CA204647, CA264840, CA230425, CA268306, CA258270, CA222112, CA165049, CA222037, CA259725, CA114043, CA233931, CA259471)

SEQ ID No. 137: SCJFRT2055G07.g
(CA096216, CA243260, CA285937, CA230920, CA140859, CA083416)

SEQ ID No. 138: SCJFRZ2007F10.g
(CA162683, CA160048, CA279259, CA151224, CA159697, CA156537, CA162591, CA113918, CA160134, CA162626, CA081758, CA165192, CA159782, CA162706, CA151304, CA266640)

SEQ ID No. 139: SCJFRZ2012F04.g
(CA151819, CA226484, CA196727, CA176517, CA200020)

SEQ ID No. 140: SCJFRZ2034D04.g
(CA293545, CA237627, CA152997)

SEQ ID No. 141: SCJFRZ3C03H08.g
(CA159498, CA159411)

SEQ ID No. 142: SCJFST1009H11.g
(CA176832, CA174223, CA174300)

SEQ ID No. 143: SCJLLR1054C03.g
(CA072193, CA122571, CA137632, CA070187, CA191143, CA188078, CA249372, CA249371, CA077923, CA208829, CA208828, CA070105, CA261620)

SEQ ID No. 144: SCJLRT1016G06.g
(CA135201, CA141549)

SEQ ID No. 145: SCJLRT1021D12.g
(CA169233, CA144275, CA169232, CA076021, CA075936, CA184045, CA135772, CA095372, CA216051, CA168410)

SEQ ID No. 146: SCJLRT1023A09.g
(SCJLRT1023A09.g, CA182963, CA250841, CA248659)

SEQ ID No. 147: SCJLRZ1021D12.g
(CA242041, CA249059, CA254109, CA213847, CA137917, CA148975, CA118183, CA214586, CA197889, CA144551, CA196585, CA262465)

SEQ ID No. 148: SCJLST1022A12.g
(CA212757, CA175747, CA184421)

SEQ ID No. 149: SCMCLR1123E10.g
(CA123814, CA077430, CA225563)

SEQ ID No. 150: SCMCRT2103B04.g
(CA172001, CA142458, CA218053)

SEQ ID No. 151: SCMCSD2061D05.g
(CA281642, CA278782, CA287422)

SEQ ID No. 152: SCQGHR1010D02.g
(CA106316)

SEQ ID No. 153: SCQGHR1012B09.g
(CA287612, CA106449)

SEQ ID No. 154: SCQGLR1085F11.g
(CA264338, CA126544, CA192941, CA167483, CA123056, CA124270, CA272314, CA261490, CA279307, CA265550, CA271792, CA122975, CA264343, CA270329, CA273106)

SEQ ID No. 155: SCQGRT1040G03.g
(CA142863, CA142796, CA136289)

SEQ ID No. 156: SCQGSB1082E12.g
(CA170065)

SEQ ID No. 157: SCQSRT1036D03.g
(CA136902, CA135021, CA287878, CA274443, CA296937, CA138673, CA191058)

SEQ ID No. 158: SCQSSB1077D06.g
(CA170725)

SEQ ID No. 159: SCRFHR1009G06.g
(CA217470, CA107403, CA198006, CA217550)

SEQ ID No. 160: SCRFLR1012D12.g
(CA215552, CA192043, CA124962, CA125195, CA145888, CA121817, CA278865, CA174653, CA248262, CA272947, CA260358, CA291459, CA203303, CA143179, CA141645, CA178853, CA187649, CA206782, CA090093, CA143252, CA278919)

SEQ ID No. 161: SCRFLR1012F12.g
(CA145277, CA176384, CA102865, CA218229, CA171925, CA191792, CA195660, CA218314, CA240492, CA198659, CA244914, CA182463, CA131724, CA244997, CA171817, CA194382, CA205344, CA170805, CA205416, CA173212, CA170885, CA181179, CA170637, CA183044, CA195239, CA206962, CA185418, CA139670, CA195249, CA176430, CA181413, CA181342, CA091964, CA183864, CA222085, CA258352, CA140506, CA180474, CA119811, CA222017, CA195130, CA185570, CA296593, CA194982, CA183360, CA173154, CA186079, CA296664, CA171270, CA195468, CA183252, CA294806, CA132456, CA195394, CA206688, CA256506, CA131509, CA187503, CA256594, CA108050, CA159196, CA240650, CA177662, CA159279, CA177742, CA239913, CA171438, CA156947, CA173255, CA256346, CA235445, CA256418, CA186679, CA219554, CA187631, CA186748, CA245097, CA185375, CA219625, CA181621, CA187266, CA123999, CA244218, CA245173, CA182407, CA253693, CA184655, CA143210, CA180512, CA256622, CA244292, CA18S011, CA143274, CA168051, CA130540, CA207436, CA219682, CA066624, CA216694, CA178229, CA256208, CA213213, CA171923, CA189901, CA181034, CA102783, CA146612, CA118091, CA130413, CA185759, CA180234, CA184401, CA069670, CA186382, CA186701, CA164112, CA186458, CA186769, CA191147, CA181041, CA191952, CA298549, CA187520, CA155473, CA111918, CA181356, CA215886, CA145798, CA143022, CA249269, CA168083, CA215375, CA073688, CA161824, CA216676, CA198787, CA145199, CA254628, CA186888, CA213066, CA091970, CA215884, CA143890, CA222334, CA220813, CA171807, CA181203, CA130692, CA186145, CA260159, CA158846, CA064841, CA295391, CA192487, CA132539, CA300897, CA141052, CA155506, CA182241, CA187303, CA258020, CA066321, CA125200, CA170189, CA108039, CA159362, CA173331, CA298200, CA101575, CA159451, CA116648, CA183460, CA107663, CA240851, CA289373, CA185342, CA240929, CA216040, CA186847, CA181218, CA172612, CA180663, CA136914, CA217359, CA163192, CA172697, CA228382, CA217429, CA159166, CA185025, CA192456, CA102223, CA156933, CA101474, CA183302, CA186227, CA159239, CA269601, CA181346, CA102790, CA187044, CA184058, CA195530, CA255719, CA136787, CA255803, CA140448, CA247100, CA183704, CA222949, CA183064, CA168215, CA292284, CA272087, CA174156, CA131207, CA203204, CA181678, CA195537, CA174230,

TABLE IV-continued

List of Sugarcane Assembled Sequences (SAS) and their SEQ ID Nos.
The EST Genbank accession numbers are in parentheses. The SEQ ID No. refers to the sequence identifiers in the sequence listings. The listed ESTs assembled to the indicated sequence and should be considered one transcript. Each SAS is differentially expressed between plants with low and high sucrose content.

CA113053, CA213323, CA181745, CA183105, CA137679, CA221917, CA234916, CA191379, CA207396, CA249902, CA203603, CA257333, CA192868, CA108462, CA131411, CA272376, CA194489, CA249816, CA257417, CA207923, CA183017, CA194671, CA163065, CA185665, CA257591, CA182994, CA279934, CA208015, CA186256, CA177351, CA132757, CA146153, CA172253, CA181813, CA182473, CA181263; CA182486, CA185227, CA144437, CA210632, CA179930, CA163280, CA178697, CA187150, CA102845, CA183295, CA203119, CA167619, CA183126, CA240601, CA167572, CA197131, CA187498, CA187269, CA181877, CA154563, CA166216, CA198634, CA255532, CA221973, CA205215, CA165092, CA211170, CA179824, CA185664, CA162302, CA185103, CA138255, CA173288, CA168237, CA234213, CA138061, CA256349, CA170955, CA162207, CA168159, CA134163, CA181092, CA256421, CA081501, CA134612, CA216664, CA171033, CA180502, CA108052, CA134694, CA242240, CA185226, CA193845, CA210899, CA159347, CA266029, CA159436, CA171415, CA135255, CA233811, CA171999, CA187597, CA180638, CA135773, CA253334, CA131134, CA182234, CA184039, CA166175, CA180410, CA280449, CA297478, CA194983, CA215483, CA264565, CA107740)

SEQ ID No. 162: SCRFLR1034G06.g
(CA241449, CA235335, CA117136, CA164653, CA178183, CA254415, CA125238, CA164095, CA222593, CA230775, CA129494, CA187277, CA096098, CA163037, CA217349, CA216252, CA163492)

SEQ ID No. 163: SCRFLR2037F09.g
(CA209741, CA268887, CA178192, CA261014, CA242867, CA265801, CA199228, CA129199, CA263453, CA263426, CA146361, CA212193, CA198338, CA263428, CA292726)

SEQ ID No. 164: SCRUAD1063D03.g
(CA068586, CA068642, CA209109, CA068658, CA068557)

SEQ ID No. 165: SCRUAD1064B08.g
(CA068774, CA209078, CA068700)

SEQ ID No. 166: SCRUFL1112F04.b
(CA249652, CA097438, CA097351)

SEQ ID No. 167: SCRULB1060F05.g
(CA173325, CA260726, CA086474, CA255253, CA258837, CA166401, CA075394, CA076741, CA220439, CA079619, CA202888, CA275737, CA272422, CA086576, CA261359, CA115018, CA176599)

SEQ ID No. 168: SCRULB2065G10.g
(CA271141, CA266659, CA271226)

SEQ ID No. 169: SCRUSB1062E12.g
(CA169672, CA208550, CA182671, CA171140, CA184190)

SEQ ID No. 170: SCSBAD1084C01.g
(CA104637, CA090516, CA196055, CA105810, CA069997, CA104732, CA225658, CA250072, CA255717, CA256367, CA256852, CA104815, CA255801, CA223408, CA217811, CA230204, CA222042, CA266094, CA202055)

SEQ ID No. 171: SCSBAM1084E01.g
(CA134918, CA160648, CA271201, CA163376, CA159473, CA079123, CA287106)

SEQ ID No. 172: SCSBAM1085B06.g
(CA155118, CA160431, CA238835, CA164387, CA159328, CA079174, CA166634, CA111526)

SEQ ID No. 173: SCSBAM1086F04.g
(CA079296)

SEQ ID No. 174: SCSBHR1050B11.g
(CA210645, CA170681, CA167697, CA107340, CA215631, CA206834, CA108412, CA182286, CA197994, CA277167, CA163113, CA192646, CA276916, CA265467, CA181920, CA184384, CA273323, CA211222, CA211754, CA185581, CA219190, CA260157, CA102243, CA286611, CA185579, CA218411, CA288879, CA193027, CA229712, CA196151, CA218111, CA212330, CA256722, CA283661, CA195272, CA206786, CA197939, CA102985, CA182506, CA284298, CA268890, CA068317, CA213471, CA211376, CA124505, CA068559, CA110532, CA110645, CA196292, CA274987, CA291082)

SEQ ID No. 175: SCSBHR1052E03.g
(CA109838, CA103669, CA108022)

SEQ ID No. 176: SCSBSD2029D11.g
(CA273475, CA291058, CA296853, SCEPSD1006B07.g, CA296781)

SEQ ID NO. 177: SCSBSD2029F05.g
(CA277625, CA286610, CA287004, CA286219)

SEQ ID NO. 178: SCSBST3096H04.g
(CA250727, CA185029, CA081571, CA209300, CA099207)

SEQ ID NO. 179: SCSFAD1125C08.g
(CA218816, CA217232, CA265904)

SEQ ID NO. 180: SCSGAM1094D05.g
(CA162116, CA086160, CA079959, CA166087, CA164634, CA259450, CA162089, CA268215, CA162088, CA088600, CA268472, CA260072, CA265273, CA155162)

SEQ ID NO. 181: SCSGFL4193B05.g
(CA256924, CA227764, CA065586)

SEQ ID NO. 182: SCSGHR1069F04.b
(CA068965, CA109244)

SEQ ID NO. 183: SCSGLR1045F05.g
(CA227916, CA126326, CA235027, CA271367, CA096003, CA217599, CA092647, CA123937, CA126293, CA212141, CA184768, CA103141, CA109865, CA103057, CA198702, CA103058)

SEQ ID NO. 184: SCSGSB1009D11.g
(CA172723, CA195396, CA172640)

SEQ ID NO. 185: SCUTAM2005B03.g
(CA090809, CA245425)

SEQ ID NO. 186: SCUTAM2115C12.g
(CA086564, CA086570, CA092157)

SEQ ID NO. 187: SCUTLR2023D06.g
(CA243852, CA300860, CA067973, CA111863, CA261222, CA116646, CA107988, CA176922, CA173185, CA085544, CA264052, CA129911, CA208820, CA070339)

SEQ ID NO. 188: SCUTRZ2022G04.g
(CA282192, CA102010, CA299087, CA217805, CA162851, CA237908, CA101358, CA289898, CA293565, CA122383, CA070388, CA177777, CA069853, CA153426, CA248297, CA159447)

TABLE IV-continued

List of Sugarcane Assembled Sequences (SAS) and their SEQ ID Nos.
The EST Genbank accession numbers are in parentheses. The SEQ ID No. refers to the sequence identifiers in the sequence listings. The listed ESTs assembled to the indicated sequence and should be considered one transcript. Each SAS is differentially expressed between plants with low and high sucrose content.

SEQ ID NO. 189: SCUTST3084F06.g
(CA186860, CA273919, CA181491, CA213324, CA181556)

SEQ ID NO. 190: SCUTST3152C08.g
(CA209403, CA181973, CA187843)

SEQ ID NO. 191: SCVPAM1055A12.g
(CA099145, CA234768, CA279908, CA080282, CA243494, CA065806, CA162304, CA074300, CA198499, CA234769, CA099202, CA218059)

SEQ ID NO. 192: SCVPCL6041F01.g
(CA233726, CA099858, CA222285)

SEQ ID NO. 193: SCVPFL3040D12.g
(CA246849, CA247391, CA225824)

SEQ ID NO. 194: SCVPFL3045B09.g
(CA244206, CA242703, CA242545, CA227029, CA254139, CA255498, CA243610, CA228891, CA256240, CA241190, CA226680, CA230797, CA241549)

SEQ ID NO. 195: SCVPLR1049B12.g
(CA128277, CA128268, CA113688, CA280120, CA201390, CA126944, CA263569, CA111798, CA142645, CA117891)

SEQ ID NO. 196: SCVPLR2005G05.g
(CA115417, CA269672, CA275150, CA196175, CA136519, CA150580, CA111903, CA181691, CA285411, CA071020, CA199358, CA253634, CA100886, CA199448, CA229814, CA164912, CA205467, CA104448, CA274931, CA238127, CA130082, CA265998, CA104535, CA110496, CA229735, CA266059, CA151909, CA215144, CA214637, CA175326, CA277166, CA095092, CA166114, CA197942, CA200312, CA187461, CA214780, CA273212, CA110942, CA180970, CA254976, CA243592, CA219837, CA214623)

SEQ ID NO. 197: SCVPLR2012A10.g
(CA128947, CA084780, CA130173, CA112670, CA081361, CA091553, CA189411, CA074286)

SEQ ID NO. 198: SCVPLR2027D02.g
(CA139889, CA281733, CA276600, CA137157, CA287148, CA196795, CA121234, CA190870, CA121263, CA285555, CA271374, CA218165, CA101129, CA275809, CA219005, CA191396, CA218180, CA218095, CA190921, CA135275, CA103450, CA132968, CA218924, CA218108, CA290505, CA130317, CA110080, CA143050, CA145955, CA131998, CA143749, CA145806, CA108915, CA187045, CA141195, CA140686, CA103304, CA108830, CA102906, CA219000, CA282088)

SEQ ID NO. 199: SCVPRT2074D04.g
(CA216242, CA101435, CA136611, CA237797, CA108537, CA090875, CA145883, CA175433, CA177864, CA145938, CA164642)

SEQ ID NO. 200: SCVPRT2081G05.g
(CA146516)

SEQ ID NO. 201: SCVPRZ2038C12.g
(CA116869, CA116232, CA246884, CA229323, CA101842, CA138831, CA095760, CA069655, CA170285, CA195638, CA133601, CA067592, CA291694, CA112695, CA217972, CA273837, CA067665, CA247936, CA144990, CA136455, CA278472, CA142261, CA247884, CA169426, CA136187, CA140235, CA294606, CA290785, CA138166, CA095965, CA169509, CA289245, CA290853, CA238260, CA284373, CA253974, CA274756, CA174589, CA197138, CA089467, CA176404, CA301325, CA176402, CA108223, CA263499, CA089556, CA085065, CA145765, CA209854, CA078829, CA185533, CA284004, CA223109, CA184146, CA196166, CA229320, CA133147, CA231712, CA287218, CA221504, CA153992, CA088034, CA267926, CA178000, CA237734, CA225054, CA203790, CA232984, CA300291, CA278621, CA204937, CA226326, CA100069, CA254749, CA096038, CA129441, CA096280, CA298558, CA246279, CA242469, CA199423, CA299287, CA122008, CA187480, CA240020, CA283618, CA277794, CA273434, CA207921, CA205591, CA138290, CA265687, CA246929, CA084012, CA102242)

SEQ ID NO. 202: SCVPRZ2043F09.g
(CA154468, CA276289)

SEQ ID NO. 203: SCVPRZ3025G09.g
(CA166458, CA215142, CA219273, CA067980, CA219244)

TABLE V

Genes differentially expressed between a high brix pool of eight plants and a low brix pool of eight plants.
The individuals were selected from an F3 progeny of a cross between *Saccharum officinarum* and *Saccharum spontaneum* genotypes. RNA samples from the indicated tissues were used to generate probes for cDNA microarray hybridizations. The fifth column indicates the average ratios (fold induction) in high against low brix comparisons. The last column indicates the average ratios (fold induction) in low against high brix comparisons. The average brix in the high brix population was 22.82. The average brix in the low population was 9.84.

| Tissue | SAS | Category | Description of homologue | High Brix | Low Brix |
|---|---|---|---|---|---|
| Internode 1 | SCJFST1009H11.g | No matches | | 2.03165 | |
| | SCCCCL3001F04.g | No matches | | 4.26102 | |
| | SCRFLR2037F09.g | Calcium | Calreticulin | | 1.58339 |
| | SCCCRZ1001H05.g | Transcription | HLH (helix-loop-helix) | 2.19048 | |
| Internode 5 | SCSBHR1050B11.g | Others | Putative senescence-associated protein | 4.01392 | |
| | SCEZST3147A10.g | Transcription | Zinc finger proteins C3H | 2.13461 | |
| | SCCCCL3080A11.b | Ubiquitination | Polyubiquitin | | 1.70138 |
| | SCCCCL3001F04.g | No matches | | 3.88735 | |

TABLE V-continued

Genes differentially expressed between a high brix pool of eight plants and a low brix pool of eight plants.
The individuals were selected from an F3 progeny of a cross between *Saccharum officinarum* and *Saccharum spontaneum* genotypes. RNA samples from the indicated tissues were used to generate probes for cDNA microarray hybridizations. The fifth column indicates the average ratios (fold induction) in high against low brix comparisons. The last column indicates the average ratios (fold induction) in low against high brix comparisons. The average brix in the high brix population was 22.82. The average brix in the low population was 9.84.

| Tissue | SAS | Category | Description of homologue | High Brix | Low Brix |
|---|---|---|---|---|---|
| | SCSBHR1050B11.g | Others | Putative senescence-associated protein | 3.99269 | |
| | SCCCLR1048F03.g | Unknown protein | | | 1.5888 |
| | SCQGHR1012B09.g | Stress | Probable cytochrome P450 monooxygenase | 6.70883 | |
| | SCEQRT1033F01.g | | Zinc finger proteins C2C2/Dof | 4.19139 | |
| | SCCCLR1C03H09.g | Ubiquitination | Polyubiquitin | | 1.76444 |
| | SCVPRZ2038C12.g | Ubiquitination | Polyubiquitin | | 1.68302 |
| Internode 9 | SCJLLR1054C03.g | Protein kinases | Undefined | 2.81512 | |
| | SCEZRZ3098G10.g | Pathogenicity | Protease inhibitors thaumatin | 2.44691 | |
| | SCVPFL3046C06.b | Protein Phosphatases | Serine/Threonine - PPM Family PP2C Catalytic Subunit | 2.84969 | |
| | SCJFRZ2007F10.g | Development | ARC1 (arm repeat protein) | | 3.02837 |
| | SCCCRZ1004H12.g | Transcription | EIL (ethylene-insensitive3-like) | | 2.47389 |
| | SCCCLR1C03H09.g | Ubiquitination | Polyubiquitin | | 3.36544 |
| | SCVPRZ2038C12.g | Ubiquitination | Polyubiquitin | | 2.93819 |
| | SCBFSB1046D04.g | Protein kinases | Calcium-related CBL-interacting | 2.48022 | |
| | SCJFRZ2012F04.g | Receptors | Receptor Ser/Thr kinase RLK Undefined | 2.471 | |
| | SCCCRZ1002E08.g | Stress | Drought and cold response putative aquaporin | | 2.95528 |
| | SCAGLR1043E04.g | Stress | Cytochrome P450 CYP74A | | 2.77448 |
| | SCCCLR2003E10.g | Transcription | NAM NAC | | 2.61186 |
| | SCCCLR1048F03.g | Unknown protein | | | 4.17702 |
| | SCBGLR1115D10.g | No matches | | 2.14401 | |
| | SCCCAM1001A03.g | Calcium | Calmodulin-binding proteins Multidrug resistant-like | 2.16906 | |
| | SCUTAM2005B03.g | Stress | Cytochrome P450 CYP90 | 2.27431 | |
| | SCVPCL6041F01.g | Receptors | Receptor Ser/Thr kinase RLK with lectin domain | | 1.82155 |
| | SCCCRZ1001F02.g | Stress | Drought and cold response putative aquaporin | | 2.01257 |
| | SCRUFL1112F04.b | Others | RNA stability UDP-GlcNAc | | 2.45556 |
| Leaf | SCACLR1036B06.g | Protein kinases | Calcium-related CBL-interacting | | 1.98763 |
| | SCEPLR1030B03.g | Pathogenicity | R-genes (receptors) With LRR/Tomato LRP protein | | 1.56394 |
| | SCBGLR1099G02.g | Transcription | AP2/EREBP DREB1 | 2.17826 | |
| | SCCCCL3120C09.g | Receptors | Receptor Ser/Thr kinase RLK with Lys domain | | 1.96465 |
| | SCJFLR1035E04.g | Transcription | Scarecrow | | 1.53914 |
| | SCACLR2014E12.g | Ubiquitination | E2 | | 1.66079 |
| | SCCCSD2001E05.g | Pathogenicity | Protease inhibitors thaumatin | | 2.19065 |
| | SCCCLR1068D03.g | Small GTPases | Rab | | 1.83141 |
| | SCAGLR1043E04.g | Stress | Cytochrome P450 CYP74A | | 1.88887 |
| | SCEQRT1024E12.g | Hormone biosynthesis | Salicylic Acid | | 2.01108 |
| | SCSGFL4193B05.g | Stress | Cytochrome P450 CYP73 | | 1.98329 |
| | SCCCCL3001F04.g | No matches | | 2.18921 | |
| | SCCCLR1001E04.g | House keeping/controls | Rubisco small subunit | | 2.33399 |
| | SCBGLR1003D06.g | Ubiquitination | E2 | | 1.97415 |
| | SCEQRT2099H01.g | Protein kinases | Calcium-related CDPK | | 1.62919 |
| | SCACCL6008H06.g | Stress | Drought and cold response Low temperature induced (L$$ | | 1.87927 |
| | SCCCRZ1002E08.g | Stress | Drought and cold response putative aquaporin | | 1.76115 |
| | SCBFST3136A06.g | No matches | | | 2.23606 |
| | SCEQRT1026H08.g | Stress | Cytochrome P450 CYP75 | | 1.88583 |
| | SCVPFL3045B09.g | Stress | Metalothionein | | 2.01704 |
| | SCSGHR1069F04.b | Stress | Cytochrome P450 | 2.51921 | |
| | SCQSRT1036D03.g | Pathogenicity | R-genes transduction PR | | 1.87037 |
| | SCAGLR2026G12.g | No matches | | | 1.94474 |
| | SCEQRT1028C03.g | Pathogenicity | R-genes transduction PR | | 2.41575 |
| | SCUTRZ2022G04.g | Others | Heat shock protein | | 2.3825 |
| | SCQGSB1082E12.g | Receptors | Receptor Ser/Thr kinase RLK Undefined | | 2.41928 |

TABLE VI

Genes differentially expressed between a high brix pool of eight plants and a low brix pool of eight plants.
The individuals were selected from an F1 progeny of a cross between two commercial varieties, SP80-144 and SP85-7215. RNA samples from the indicated tissues were used to generate probes for cDNA microarray hybridizations. The fifth column indicates the average ratios (fold induction) in high against low brix comparisons. The last column indicates the average ratios (fold induction) in low against high brix comparisons. The average brix in the high brix population was 14.36. The average brix in the low population was 8.87.

| Tissue | SAS | Category | Description of homologue | High Brix | Low Brix |
|---|---|---|---|---|---|
| Leaf | SCVPRZ2043F09.g | Receptors | Receptor Ser/Thr kinase RLK Undefined | | 2.94471 |
| | SCCCSD2C03G12.g | Pathogenicity | Fungal resistance Undefined | | 4.43542 |
| | SCJFRT1007E01.g | Stress | Dioxygenases | | 1.94338 |
| | SCUTAM2115C12.g | Unknown protein | | | 2.21849 |
| | SCSBAM1086F04.g | Receptors | Receptor Ser/Thr kinase RLK Undefined | | 2.77975 |
| | SCCCSD1092A08.g | No matches | | | 3.85136 |
| | SCVPRZ3025G09.g | Hormone biosynthesis | Jasmonic Acid 12-oxo-phytodienoate reductase | | 5.65617 |
| | SCAGAM2125C01.g | Receptors | Receptor Ser/Thr kinase RLK Undefined | | 1.59055 |
| | SCCCST1006B11.g | Protein kinases | SNF1-related | | 2.62841 |
| | SCJLST1022A12.g | Receptors | Receptor Ser/Thr kinase RLK Undefined with LRR | | 2.81094 |
| | SCRULB1060F05.g | Inositol | Inositol kinases 1-Phosphatidylinositol 4-kinase | | 7.28074 |
| | SCJFFL3C03C02.g | No matches | | | 2.07492 |
| | SCCCCL4005F05.g | Protein kineses | Undefined | | 2.29254 |
| | SCVPFL3040D12.g | Transcription | CREB-binding/acetyltransferase-related | | 3.10639 |
| | SCSGLR1045F05.g | Unknown protein | | 1.69705 | |
| | SCMCLR1123E10.g | Others | T-complex protein (chaperonin) | 3.08493 | |
| | SCCCRZ1001C01.g | Stress | Drought-induced | 2.21354 | |
| | SCCCLR1C05B03.g | Transcription | Myb | 2.39082 | |
| | SCBFLR1039B05.g | Others | Xyloglucan endotransglycosylase | 2.72608 | |
| | SCSBSD2029D11.g | No matches | | 2.0015 | |
| | SCVPCL6041F01.g | Receptors | Receptor Ser/Thr kinase RLK with lectin domain | 3.02993 | |
| | SCCCLR2001H09.g | Stress | Thioredoxin | 1.82511 | |
| | SCBGLR1096E06.g | Others | Putative inosine monophosphate dehydrogenase | 2.29479 | |
| | SCQSSB1077D06.g | Receptors | Receptor Ser/Thr kinase RLK Undefined | 1.95563 | |
| | SCEZLB1009A09.g | Hormone related | Similar to BLE1 protein | 2.29938 | |
| | SCEZLR1052E07.g | No matches | | 2.98578 | |
| | SCCCCL4002E02.g | Others | Extensin | 1.87858 | |
| | SCCCRZ2003E12.g | Transcription | bZIP | 2.41759 | |
| | SCCCLB1001D03.g | Protein Phosphatases | Serine/Threonine - PPP Family PP2A/Catalytic Subunit | 1.88391 | |
| | SCAGLB1070E01.g | Receptors | Receptor Ser/Thr kinase RLK Undefined | 7.40783 | |
| | SCJLRZ1021D12.g | Receptors | Receptor Ser/Thr kinase RLK undefined with LRR | 3.33105 | |
| | SCCCRT2002G11.g | Protein kinase | Cell cycle-related MHK (male germ cell associated) | 3.57013 | |
| | SCCCLR2C02D03.g | Calcium | Calmodulin-binding proteins Chaperonin 10 | 1.94335 | |
| | SCCCRT2002G11.g | Protein kinase | Cell cycle-related MHK (male germ cell associated) | 3.77176 | |

TABLE VII

Genes differentially expressed between a high brix variety and a low brix variety.
Two individuals were selected from SP83-2847 and two individuals from SP91-1049. RNA samples from the indicated tissues were used to generate probes for cDNA microarray hybridizations. The fifth column indicates the average ratios (fold induction) in high against low brix comparisons. The last column indicates the average ratios (fold induction) in low against high brix comparisons. The average brix in SP91-1049 was 20.2. The average brix in SP83-2847 was 16.2.

| Tissue | SAS | Category | Description of homologue | High Brix | Low Brix |
|---|---|---|---|---|---|
| Leaf | SCCCLR2002F08.g | Hormone related | Auxin auxin repressed | | 2.48663 |
| | SCRUAD1064B08.g | No matches | | | 6.06841 |
| | SCEQRT1024E12.g | Hormone biosynthesis | Salicylic Acid | 1.58685 | |
| | SCBFST3136A06.g | No matches | | 2.2018 | |
| | SCSGSB1009D11.g | Unknown protein | | 4.54795 | |
| | SCACCL6008H06.g | Stress | Drought and cold response Low temperature induced (LTI) | 4.15788 | |
| | SCSBAM1085B06.g | Hormone biosynthesis | Jasmonic Acid Linoleic acid desaturase | 2.43754 | |
| | SCJLRT1016G06.g | Stress | Wound-Induced Ribonuclease | 4.45431 | |
| | SCCCLR1024C03.g | Stress | Drought and cold response putative aquaporin | 1.72509 | |
| | SCCCLR1001E04.g | House keeping/controls | Rubisco small subunit | 3.10813 | |

TABLE VIII

Genes differentially expressed between a high brix variety and a low brix variety.
Two individuals were selected from SP89-1115 and two individuals from SP94-3116.
RNA samples from the indicated tissues were used to generate probes for cDNA microarray hybridizations. The fifth column indicates the average ratios (fold induction) in high against low brix comparisons. The last column indicates the average ratios (fold induction) in low against high brix comparisons. The average brix in SP89-1115 was 19.9. The average brix in SP94-3116 was 14.2.

| Tissue | SAS | Category | Description of homologue | High Brix | Low Brix |
|---|---|---|---|---|---|
| Leaf | SCAGSD2042G08.g | No matches | | | 2.56194 |
| | SCEQRT1033H06.g | Receptors | Receptor Ser/Thr kinase RLK undefined with LRR | | 2.58749 |
| | SCJLRT1016G06.g | Stress | Wound-induced Ribonuclease | | 2.4137 |
| | SCEQRT1024B02.g | Protein kinases | Undefined (with insertion domain) | 5.41746 | |
| | SCCCRZ2001A10.g | Inositol | Inositol kinases 1-Phosphatidylinositol 4-kinase | 3.90421 | |
| | SCCCLR1022B11.g | Stress | Drought and cold response Cysteine proteinase RD19A precursor | 1.74873 | |
| | SCBFLR1060F03.g | Receptors | Receptor Ser/Thr kinase RLK undefined with LRR | 3.23768 | |

TABLE IX

Genes differentially expressed between a high brix pool of eight plants and a low brix pool of eight plants.
The individuals were selected from an F1 progeny of a cross between two commercial varieties, SP80-180 and SP80-4966. RNA samples from the indicated tissues were collected from March to July and used to generate probes for cDNA microarray hybridizations. The fifth column indicates the average ratios (fold induction) in high against low brix comparisons. The last column indicates the average ratios (fold induction) in low against high brix comparisons. The average brix in the high brix population was 18.47 in March, 21.79 in May and 22.63 in July. The average brix in the low population was 13.66 in March, 17.59 in May and 18.96 in July.

| Tissue | SAS | Category | Description of homologue | High Brix | Low Brix |
|---|---|---|---|---|---|
| Internode 1 march | SCEPLR1030E06.g | Receptors | Receptor Ser/Thr kinase RLK undefined with LRR | 1.87064 | |
| | SCACLR2007G02.g | Protein kinases | Others Abcisic acid-inducible | 1.90147 | |
| | SCEZLB1012F10.g | Calcium | Calmodulin-binding proteins GNGC family | 1.88909 | |
| | SCEQRT1024E12.g | Hormone biosynthesis | Salicyclic Acid | 1.85544 | |
| | SCJLRT1016G06.g | Stress | Wound-induced Ribonuclease | 2.07306 | |
| | SCJFRT1005C11.g | Hormone biosynthesis | Ethylene ACC oxidase | 3.48319 | |
| | SCVPLR2005G05.g | Others | Putative Mob1/phocein family protein | 1.6251 | |
| | SCEQRT1026H08.g | Stress | Cytochrome P450 CYP75 | | 2.40851 |
| | SCCCLR1C04C02.g | No matches | | | 2.07835 |
| | SCQGHR1010D02.g | Others | Putative terpene synthase | | 3.02686 |
| | SCBGLR1023D05.g | Pathogenicity | R-genes transduction LSD1 | 2.21144 | |
| | SCUTRZ2022G04.g | Stress | Heat shock protein | 1.71301 | |
| | SCCCLR1C02F07.g | Inositol | Others myo-Inositol-1-phosphate synthase | 1.83045 | |
| | SCEQRT1028C03.g | Pathogenicity | R-genes transduction PR | 2.46157 | |
| | SCVPLR1049B12.g | Unknown protein | | 2.59241 | |
| | SCSBAM1084E01.g | Protein kinases | MAPK/MAPKK/MAPKKK MAPK | 1.98747 | |
| | SCCCLR2002E04.g | Others | Putative Bet v I pollen allergen | 2.2259 | |
| | SCCCCL6002B05.g | Hormone biosynthesis | Auxin Nitrilase | 1.67598 | |
| | SCJLRT1021D12.g | Stress | Wound-Induced Chalcone synthase | | 3.6397 |
| | SCVPLR2027D02.g | Stress | Wound-Induced Chalcone synthase | | 1.73982 |
| | SCEZLB1010E10.g | Transcription | Other Auxin-response factors With B3 domain | | 1.62134 |
| | SCRFLR1012D12.g | Hormone biosynthesis | Auxin Nitrilase | 1.76443 | |
| | SCCCLR1C05G07.g | Others | S-adenosylmethionine decarboxylase | 1.93684 | |
| | SCSBHR1052E03.g | Stress | ABA and stress induced | 2.27594 | |
| | SCRFLR1012F12.g | Others | caffeic acid 3-O-methyltransferase | 2.22106 | |
| | SCCCAM2C04G08.g | Receptors | Receptor Ser/Thr kinase leucine-rich transmembrane kinase (LTK1) | 1.67218 | |
| | SCACCL6008H06.g | Stress | Drought and cold response Low temperature induced (LTI) | 1.91951 | |
| | SCRFLR1034G06.g | Protein kinases | Undefined | 1.76667 | |
| | SCUTST3084F06.g | Stress | Drought and cold response Low temperature induced (LTI) | 1.73383 | |
| | SCAGLR1043E04.g | Stress | Cytochrome P450 CYP74A | | 2.05809 |
| | SCJFRT1007H07.g | Hormone biosynthesis | Jasmonic Acid Lipoxygenase | | 3.99155 |
| | SCCCRT1001E01.g | Hormone biosynthesis | Jasmonic Acid Lipoxygenase | | 2.71944 |
| Internode 1 july | SCCCLR2C01F06.g | Stress | Wound-induced | 1.78615 | |
| | SCEPRZ1010E06.g | Protein Phosphatases | Serine/Threonine - PPM Family PP2C-like | | 1.55514 |
| | SCCCLR2002F08.g | Hormone related | Auxin auxin repressed | | 1.60673 |
| | SCJFRZ3C03H08.g | Pathogenicity | R-genes (receptors) With LRR | 1.75681 | |
| | SCEQRT2098H06.g | Pathogenicity | R-genes (receptors) With LRR/NBS-LRR | 1.68827 | |
| | SCEZAM2058E08.g | Receptors | Receptor Ser/Thr kinase RLK Undefined | | 1.60291 |
| | SCACSB1037A07.g | Stress | Cytochrome P450 CYP98A | | 1.63 |
| | SCAGLR1043F02.g | Calcium | Calmodulin-binding proteins HSP70s (heat shock) | 2.03737 | |
| | SCJFRZ2007F10.g | Development | ARC1 (arm repeat protein) | 1.82989 | |

TABLE IX-continued

Genes differentially expressed between a high brix pool of eight plants and a low brix pool of eight plants.
The individuals were selected from an F1 progeny of a cross between two commercial varieties, SP80-180 and SP80-4966. RNA samples from the indicated tissues were collected from March to July and used to generate probes for cDNA microarray hybridizations. The fifth column indicates the average ratios (fold induction) in high against low brix comparisons. The last column indicates the average ratios (fold induction) in low against high brix comparisons. The average brix in the high brix population was 18.47 in March, 21.79 in May and 22.63 in July. The average brix in the low population was 13.66 in March, 17.59 in May and 18.96 in July.

| Tissue | SAS | Category | Description of homologue | High Brix | Low Brix |
|---|---|---|---|---|---|
| | SCRUSB1062E12.g | Others | Putative triacylglycerol lipase | | 1.49831 |
| | SCCCRZ1001C01.g | Stress | Drought-induced | | 1.52895 |
| | SCEZHR1088E02.g | Protein Phosphatases | Tyrosine Phosphatases Dual Specificity Protein Phosphatases (DSPP) | 1.87674 | |
| Internode 5 march | SCCCLR1066G08.g | Transcription | HGM (High mobility group protein) | 1.57463 | |
| | SCEZRZ1015G02.g | Unknown protein | Putative protein kinase Casein kinase I | 1.91199 | |
| | SCAGFL1089C03.g | Stress | Glutathione S-transferases | 2.10704 | |
| | SCEZLR1031G10.g | Protein kinases | Cell cycle-related CDC2/CRK2 | 2.14401 | |
| | SCSGSB1009D11.g | Unknown protein | | 2.09248 | |
| | SCCCFL4094H12.g | Receptors | Receptor Ser/Thr kinase RLK Undefined | 1.76665 | |
| | SCRULB2065G10.g | No matches | | | 2.15317 |
| | SCQGLR1085F11.g | Stress | Drought-Induced | | 2.7353 |
| | SCJFRZ2034D04.g | Others | SET-domain protein | | 2.69909 |
| | SCBFFL4114B06.g | Receptors | Receptor Ser/Thr kinase RLK Undefined | | 3.67808 |
| | SCEPRZ3087C08.g | Stress | Drought and cold response Low temperature induced (LTI) | | 1.78187 |
| | SCCCLR1065F03.g | Pathogenicity | R-genes (receptors) With LRR/NBS-LRR | | 1.7714 |
| | SCCCLR2C01F06.g | Stress | Wound-Induced | 2.334 | |
| | SCUTLR2023D06.g | Transcription | CCAAT Hap | 1.68942 | |
| | SCEQLR1007G03.g | Calcium | Calmodulin-binding proteins EF-1 alpha | 1.64492 | |
| | SCACLR2007G02.g | Protein kinases | Others Abcisic acid-Inducible | 1.57037 | |
| | SCUTRZ2022G04.g | Others | Heat shock protein | 2.11424 | |
| | SCQGRT1040G03.g | Development | Expansin | 1.7436 | |
| | SCEQRT1026H08.g | Stress | Cytochrome P450 CYP75 | 1.59596 | |
| | SCAGFL1089G08.g | no match | | | 2.06063 |
| | SCJFRZ3C03H08.g | Pathogenicity | R-genes (receptors) With LRR | | 2.76853 |
| | SCEQRT2098H06.g | Pathogenicity | R-genes (receptors) With LRR/NBS-LRR | | 2.6343 |
| | SCCCLR2002H11.g | Unknown protein | | | 1.64637 |
| | SCVPRT2081G05.g | Protein kinases | Cell cycle-related CDK | | 2.15674 |
| | SCCCLR1022F10.g | Others | Glycine hydroxymethyltransferase | 2.02802 | |
| | SCBFSB1047C02.g | Others | Hypothetical protein | 2.58471 | |
| | SCRULB1060F05.g | Inositol | Inositol kinases 1-Phosphatidylinositol 4-kinase | 1.65757 | |
| | SCCCLR1024A02.g | Receptors | Receptor Ser/Thr kinase RLK Undefined | 1.60332 | |
| | SCEPRZ1008F02.g | Transcription | LIM (protein-protein Interaction) | 1.833 | |
| | SCCCFL4094H12.g | Receptors | Receptor Ser/Thr kinase RLK Undefined | 1.84294 | |
| | SCACCL6008H06.g | Stress | Drought and cold response Low temperature Induced (LTI) | | 1.92651 |
| | SCJLRT1016G06.g | Stress | Wound-induced Ribonuclease | | 3.13455 |
| | SCEZST3147A10.g | Transcription | Zinc finger proteins C3H | | 2.21445 |
| | SCCCRZ1002H08.g | Others | Saposin B domain-containing protein | | 2.32254 |
| | SCCCLB1003E11.g | Protein kinases | Others REK-like | | 3.07187 |
| | SCSFAD1125C08.g | Pathogenicity | Polygalacturonase-Inhibiting | | 2.31427 |
| Internode 5 July | SCCCLR1C04G08.g | Protein kinases | Casein kinase Casein kinases I | 1.76524 | |
| | SCVPRT2074D04.g | Others | unkown protein | 1.75747 | |
| | SCJFRZ3C03H08.g | Pathogenicity | R-genes (receptors) With LRR | 2.52658 | |
| | SCRFLR1012F12.g | Others | caffeic acid 3-O-methyltransferase | | 1.63946 |
| | SCCCLR1024C03.g | Stress | Drought and cold response putative aquaporin | | 2.50238 |
| | SCEQLR1091A10.g | Others | 60S Ribosomal protein L23 | | 1.74167 |
| | SCCCRZ2C01F09.g | Ubiquitination | E2 | | 1.62723 |
| | SCEPAM1020A03.g | Protein kinases | Others ATN1-like | | 1.9435 |
| | SCSBHR1050B11.g | Others | Putative senescence-associated protein | 3.83889 | |
| | SCJFRZ2007F10.g | Development | ARC1 (arm repeat protein) | 2.38995 | |
| | SCCCRZ1001H05.g | Transcription | HLH (helix-loop-helix) | 4.15387 | |
| | SCEQRT1033F01.g | . | Zinc finger proteins C2C2/Dof | 3.65977 | |
| | SCCCLR1048D07.g | Hormone biosynthesis | Salicylic Acid | 4.58868 | |
| | SCSBHR1050B11.g | Others | Putative senescence-associated protein | 2.34488 | |
| | SCSBSD2029F05.g | Unknown protein | | | 2.73215 |
| | SCCCLR2003E10.g | Transcription | NAM NAC | | 2.44948 |
| | SCCCLR2C02A05.g | Development | Expansin | | 1.58639 |
| | SCACSB1037A07.g | Stress | Cytochrome P450 CYP98A | | 1.85253 |
| | SCCCLR1C03G01.g | Hormone biosynthesis | Jasmonic Acid Linoleic acid desaturase | | 1.47918 |
| | SCCCLR1C05B07.g | Protein kinases | Calcium-related CBL-Interacting | 2.71519 | |
| | SCSBHR1050B11.g | Others | Putative senescence-associated protein | 2.45088 | |
| | SCMCRT2103B04.g | Protein kinases | Undefined | 1.73105 | |
| | SCCCLB1003E11.g | Protein kinases | Others REK-like | 3.30364 | |
| | SCVPAM1055A12.g | Protein kinases | Casein kinases Casein kinase I | 1.67698 | |
| | SCEZHR1088E02.g | Protein Phosphatases | Tyrosine Phosphatases Dual Specificity Protein Phosphatases (DSPP) | 3.28753 | |

TABLE IX-continued

Genes differentially expressed between a high brix pool of eight plants and a low brix pool of eight plants.
The individuals were selected from an F1 progeny of a cross between two commercial varieties, SP80-180 and SP80-4966. RNA samples from the indicated tissues were collected from March to July and used to generate probes for cDNA microarray hybridizations. The fifth column indicates the average ratios (fold induction) in high against low brix comparisons. The last column indicates the average ratios (fold induction) in low against high brix comparisons. The average brix in the high brix population was 18.47 in March, 21.79 in May and 22.63 in July. The average brix in the low population was 13.66 in March, 17.59 in May and 18.96 in July.

| Tissue | SAS | Category | Description of homologue | High Brix | Low Brix |
|---|---|---|---|---|---|
| | SCCCRZ1001F02.g | Stress | Drought and cold response putative aquaporin | | 2.29254 |
| | SCEZHR1087F06.g | Stress | Cytochrome P450 CYP84 | | 2.3784 |
| | SCBFRZ2046D07.g | Protein kinases | RLCK NAK-like | | 2.13676 |
| | SCRUAD1063D03.g | No matches | | | 1.93091 |
| | SCSGFL4193B05.g | Stress | Cytochrome P450 CYP73 | | 1.58639 |
| | SCJFRZ2014A03.g | . | R-genes (receptors) With LRR/NBS-LRR | 2.52532 | |
| | SCCCLR1048F03.g | Unknown protein | | 2.10185 | |
| | SCSBHR1050B11.g | Others | Putative senescence-assosciased protein | 3.73288 | |
| Internode 9 march | SCVPLR2012A10.g | Hormone biosynthesis | Ethylene ACC oxidase | 1.78441 | |
| | SCEQRT2100B02.g | Stress | Drought and cold response putative aquaporin | 2.00347 | |
| | SCCCRZ1001F02.g | Stress | Drought and cold response putative aquaporin | 1.7121 | |
| | SCMCRT2103B04.g | Protein kinases | Undefined | 1.80135 | |
| | SCAGLR1043F02.g | Calcium | Calmodulin-binding proteins HSP70s (heat shock) | 2.89959 | |
| | SCEZHR1088E02.g | Protein Phosphatases | Tyrosine Phosphatases Dual Specificity Protein Phosphatases (DSPP) | 2.79028 | |
| | SCCCST3001H12.g | Stress | Drought and cold response putative aquaporin | 2.0084 | |
| | SCCCRZ1002E08.g | Stress | Drought and cold response putative aquaporin | 1.79386 | |
| | SCCCLR1024C03.g | Stress | Drought and cold response putative aquaporin | 1.80152 | |
| | SCJFRT2055G07.g | Ubiquitination | Polyubiquitin | 1.60639 | |
| | SCEPRZ1010E06.g | Protein Phosphatases | Serine/Threonine - PPM Family PP2C-like | | 1.53961 |
| | SCCCCL3002C09.b | Stress | Glutathione S-transferases | 1.55841 | |
| | SCEZRZ1015G02.g | Unknown protein | Putative protein kinase Casein kinase I | 1.85411 | |
| | SCCCSD2001E05.g | Pathogenicity | Protease inhibitors thaumatin | 6.05847 | |
| | SCUTST3090E03.g | Unknown protein | | 1.56216 | |
| | SCBFFL5074C09.g | Stress | Drought and cold response reversibly glycosylated polypeptide | 1.79364 | |
| | SCAGFL1089C03.g | Stress | Glutathione S-transferases | 1.6557 | |
| | SCSGSB1009D11.g | Unknown protein | | 2.4264 | |
| | SCCCSD1003E02.g | Pathogenicity | Protease inhibitors thaumatin | 4.87282 | |
| | SCCCLR2C01F06.g | Stress | Wound-induced | 3.40039 | |
| | SCCCAD1001C08.g | Stress | Peroxidases P7X | 1.97943 | |
| | SCCCAM2004G02.g | Hormone related | Auxin Auxin transport/auxin eflux carrier | | 1.78676 |
| | SCSFAD1125C08.g | Pathogenicity | Polygalacturonase-inhibiting | | 1.60435 |
| | SCCCLR1001A06.g | Others | Extensin-like protein | 1.57973 | |
| | SCAGLR1043E04.g | Stress | Cytochrome P450 CYP74A | 1.9974 | |
| | SCBFSB1047C02.g | Others | Hypothetical protein | 2.05746 | |
| | SCCCLR2C01G07.g | Protein kinases | SNF1-related | 1.76015 | |
| | SCEZHR1047A01.g | Receptors | Receptor Ser/Thr kinase RLK undefined with LRR | 1.60061 | |
| | SCVPCL6041F01.g | Receptors | Receptor Ser/Thr kinase RLK with lectin domain | 1.59157 | |
| | SCEQRT1028C03.g | Pathogenicity | R-genes transduction PR | 4.96024 | |
| | SCCCST1001C04.g | No matches | | 1.67914 | |
| | SCRFHR1009G06.g | Stress | Infected libraries | 2.02309 | |
| | SCCCCL3120G07.g | Calcium | Calmodulin-binding proteins HSP70s (heat shock) | 1.67313 | |
| | SCRFLR1012F12.g | Others | caffeic acid 3-O-methyltransferase | 1.76972 | |
| | SCMCSD2061D05.g | Protein kinases | Undefined | | 2.00471 |
| Internode 9 july | SCRFLR1012F12.g | Others | caffeic acid 3-O-methyltransferase | | 1.73901 |
| | SCCCLR1022F10.g | Others | Glycine hydroxymethyltransferase | | 1.93433 |
| | SCSGAM1094D05.g | Hormone biosynthesis | Salicylic Acid | | 1.62394 |
| | SCSBAD1084C01.g | Others | Tubulin alpha-1 chain | | 1.7221 |
| | SCSBAD1084C01.g | Others | Tubulin alpha-1 chain | | 1.70571 |
| | SCEPRZ1008F02.g | Transcription | LIM (protein-protein interaction) | | 2.3459 |
| Leaf march | SCCCAD1004H02.g | Stress | Catalases | | 2.34832 |
| | SCVPCL6042B11.g | Receptors | Receptor Ser/Thr kinase RLK Undefined | | 2.05874 |
| | SCCCLR2C01F06.g | Stress | Wound-induced | 1.68028 | |
| Leaf may | SCUTST3084F06.g | Stress | Drought and cold response Low temperature induced (LTI) | | 2.65146 |
| | SCJFLR1074E09.g | Stress | Drought and cold response Low temperature induced (LTI) | | 1.7881 |
| | SCCCLR1C08G10.g | Transcription | Myb LHY/CAA1 | 1.7247 | |
| | SCACLR1126E09.g | No matches | | 1.88699 | |
| | SCCCLR2C01F06.g | Stress | Wound-induced | | 1.98605 |
| | SCEQLB2019B08.g | Protein kinases | SNF1-related | | 2.27361 |
| | SCEQRT1031D02.g | Adapters | 14-3-3 proteins | | 1.89991 |
| | SCCCRZ1002E08.g | Stress | Drought and cold response putative aquaporin | | 2.22348 |
| | SCQGLR1085F11.g | Stress | Drought-induced | | 2.57185 |
| | SCJLRT1023A09.g | Transcription | HLH (helix-loop-helix) | | 2.21673 |
| | SCSBAM1085B06.g | Hormone biosynthesis | Jasmonic Acid Unoleic acid desaturase | 1.87983 | |
| | SCEPRZ3087C08.g | Stress | Drought and cold response Low temperature induced (LTI) | | 2.40687 |

TABLE IX-continued

Genes differentially expressed between a high brix pool of eight plants and a low brix pool of eight plants.
The individuals were selected from an F1 progeny of a cross between two commercial varieties, SP80-180 and SP80-4966. RNA samples from the indicated tissues were collected from March to July and used to generate probes for cDNA microarray hybridizations. The fifth column indicates the average ratios (fold induction) in high against low brix comparisons. The last column indicates the average ratios (fold induction) in low against high brix comparisons. The average brix in the high brix population was 18.47 in March, 21.79 in May and 22.63 in July. The average brix in the low population was 13.66 in March, 17.59 in May and 18.96 in July.

| Tissue | SAS | Category | Description of homologue | High Brix | Low Brix |
|---|---|---|---|---|---|
| | SCEQRT1025D06.g | Adapters | 14-3-3 proteins | | 2.23722 |
| | SCCCRZ2001E12.g | Transcription | HLH (helix-loop-helix) PIF-like | | 2.17995 |
| | SCUTST3152C08.g | Calcium | Calmodulin | | 1.78114 |
| | SCACCL6008H06.g | Stress | Drought and cold response Low temperature induced (LTI) | | 3.24015 |
| | SCSBST3096H04.g | Inositol | Inositol phosphatases Inositol-1,4,5-trisphosphate 5-Phosphatase | | 2.8703 |
| | SCEQRZ3020C02.g | Receptors | Receptor Ser/Thr kinase RLK undefined with LRR | 1.70665 | |
| | SCCCCL6003D08.g | Ubiquitination | F-box protein | | 1.9614 |
| | SCEQRT1025D04.g | Receptors | G-protein coupled | | 1.78293 |
| | SCEPRZ1010E06.g | Protein Phosphatases | Serine/Threonine - PPM Famliy PP2C-like | | 2.54771 |

Confirmation of Expression Data

Figure 3:
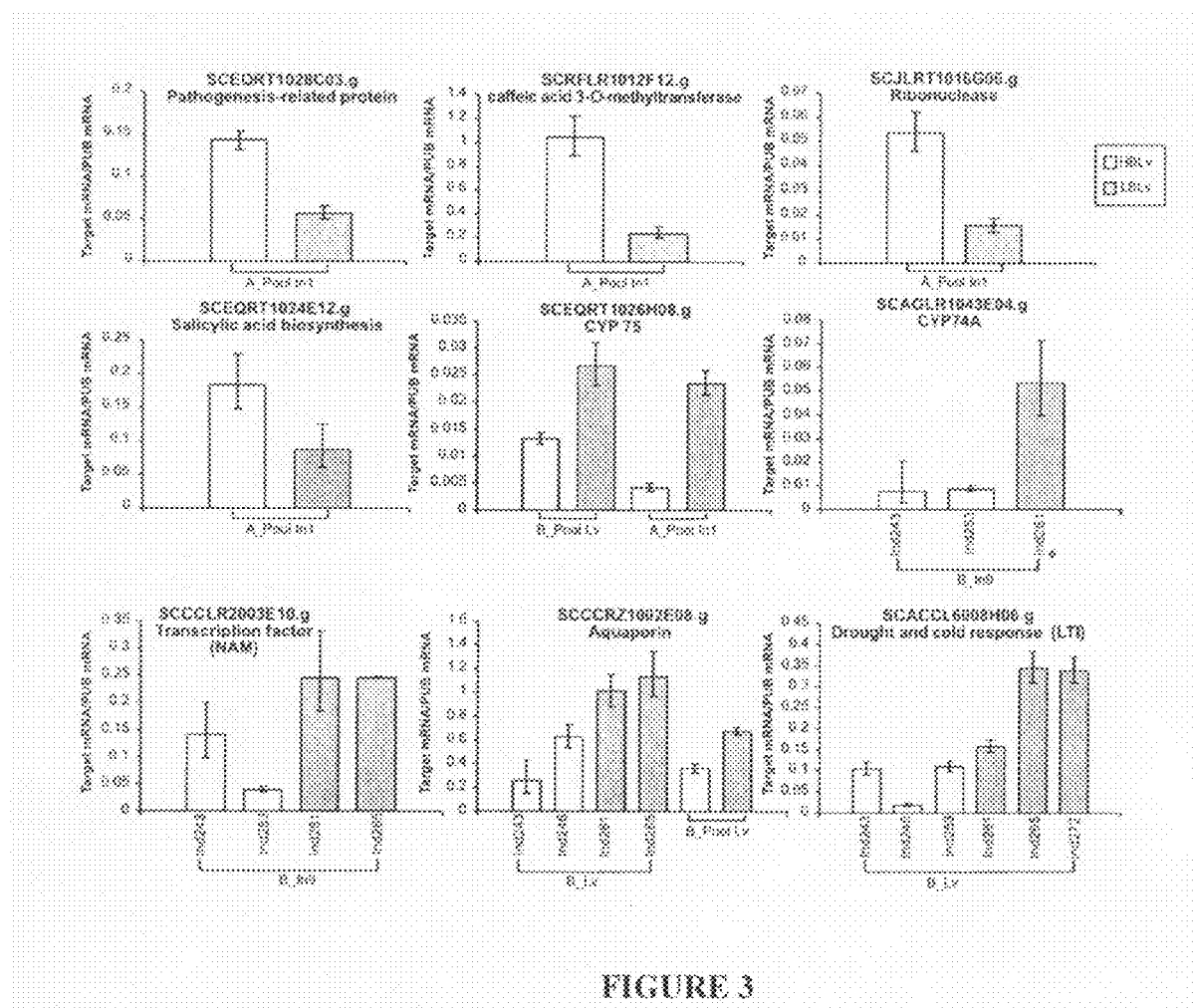
FIG. 3: Validation of gene expression data by real-time PCR. mRNA levels were determined for the indicated SAS. Reactions were done in triplicates. A polyubiquitin (PUB) gene was used as reference. The bars show target mRNA levels relative to the polyubiquitin mRNA. Error bars were calculated as described by Livak and Schmittgen (2001). RNA samples from a pool of individuals were used to generate the templates for real-time PCR reactions. Additionally, three high brix (HB) individuals, Ind243, Ind246 and Ind253, and three low brix (LB) individuals, Ind261, Ind265 and Ind272, were analysed in the case of the cross between the commercial varieties (SP80-180 and SP80-4966). A: samples derived from a cross between two commercial varieties (SP80-180 and SP80-4966), B: samples derived from multiple crossings among *S. officinarum* and *S. spontaneum* genotypes. Lv=leaf; In1=internode 1; In9=internode 9.

Real-time PCR reactions were performed to confirm the expression data obtained. cDNA templates were generated from a pool of 8 individuals from the cross between commercial varieties (SP80-180 and SP80-4966), from the multiple crossings among *S. officinarum* and *S. spontaneum* genotypes or from individual tissue samples. Leaf or internode RNA derived from three HB genotypes (CTC98-243, CTC98-246, CTC98-253) and three LB genotypes (CTC98-261, CTC98-265, CTC98-272) (FIG. 3). The mRNA levels for nine SAS show some variation in the different genotypes and pools but all transcript levels are in agreement with the expected based on microarray results.

Figure 4:
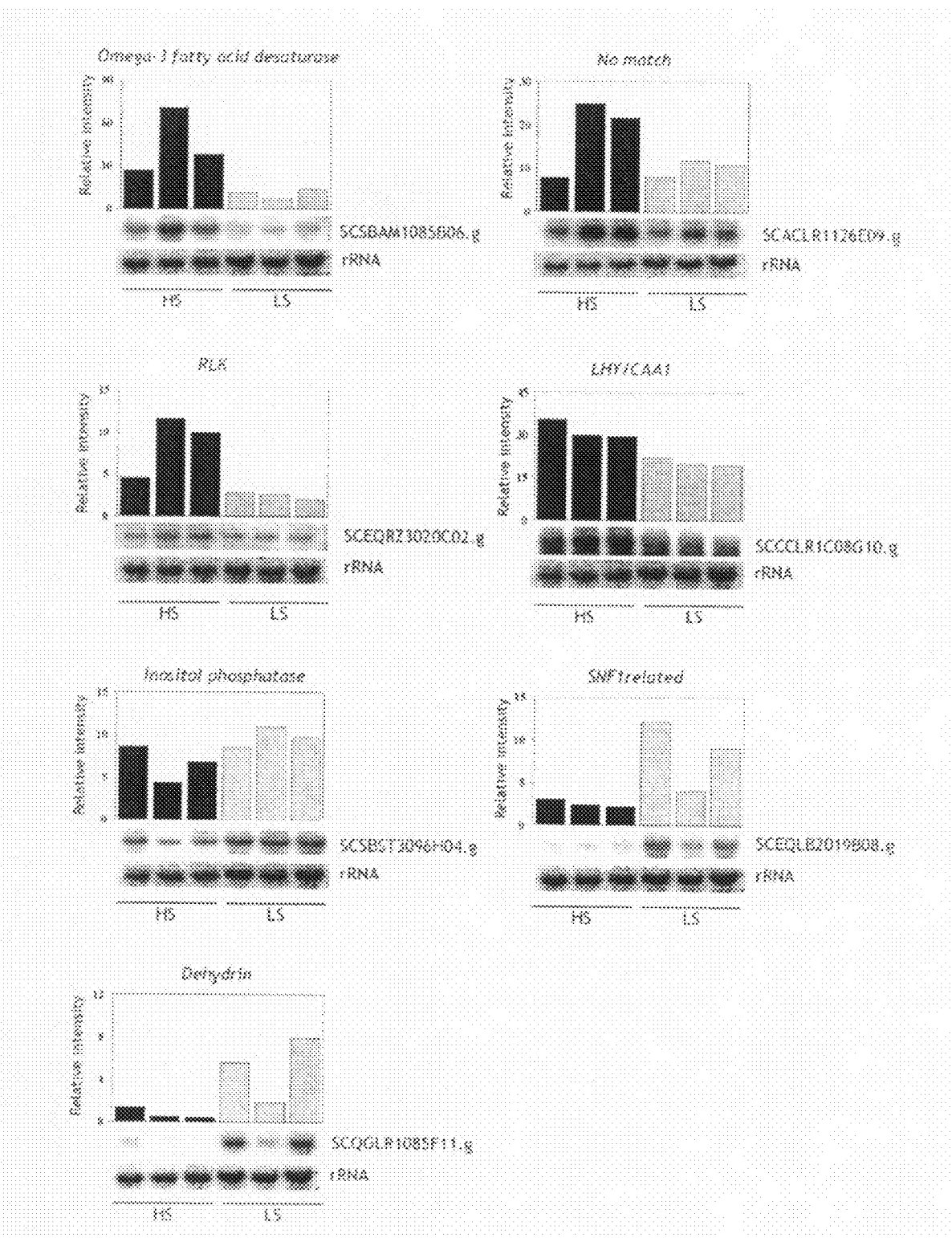
FIG. 4: Expression levels of differentially expressed genes in sugarcane individuals. RNA blots were prepared using 10 μg of total RNA isolated from mature leaves of three individual clones of each segregant population (HS—high and LS—low sugar content). The time point evaluated in the blots corresponds to the same one used in the cDNA microarray experiments (9 months after planting). Blots were hybridized with the gene-specific radioactive probes indicated. An rDNA fragment was used as a control.

The differential expression of the genes in high and low sugar content plants could also be confirmed by northern blot hybridization. Four genes with greater expression in the high sugar content plants from the SP80-180 vs. SP80-4966 progenies (SCSBAM1085B06.g, SCACLR1126E09.g, SCEQRZ3020C02.g and SCCCLR1C08G10.g) and three with increased expression in the low sugar content plants (SCSBST3096H04.g, SCEQLB2019B08.g and SCQGLR1085F11.g) were analyzed by RNA-blots using total RNA from three sugarcane individuals to provide replication for gene expression trends. FIG. 4 shows that the microarray data was confirmed in at least two of the three independent samples collected nine months after planting, indicating a high consistency between the two data sets.

Figure 5:
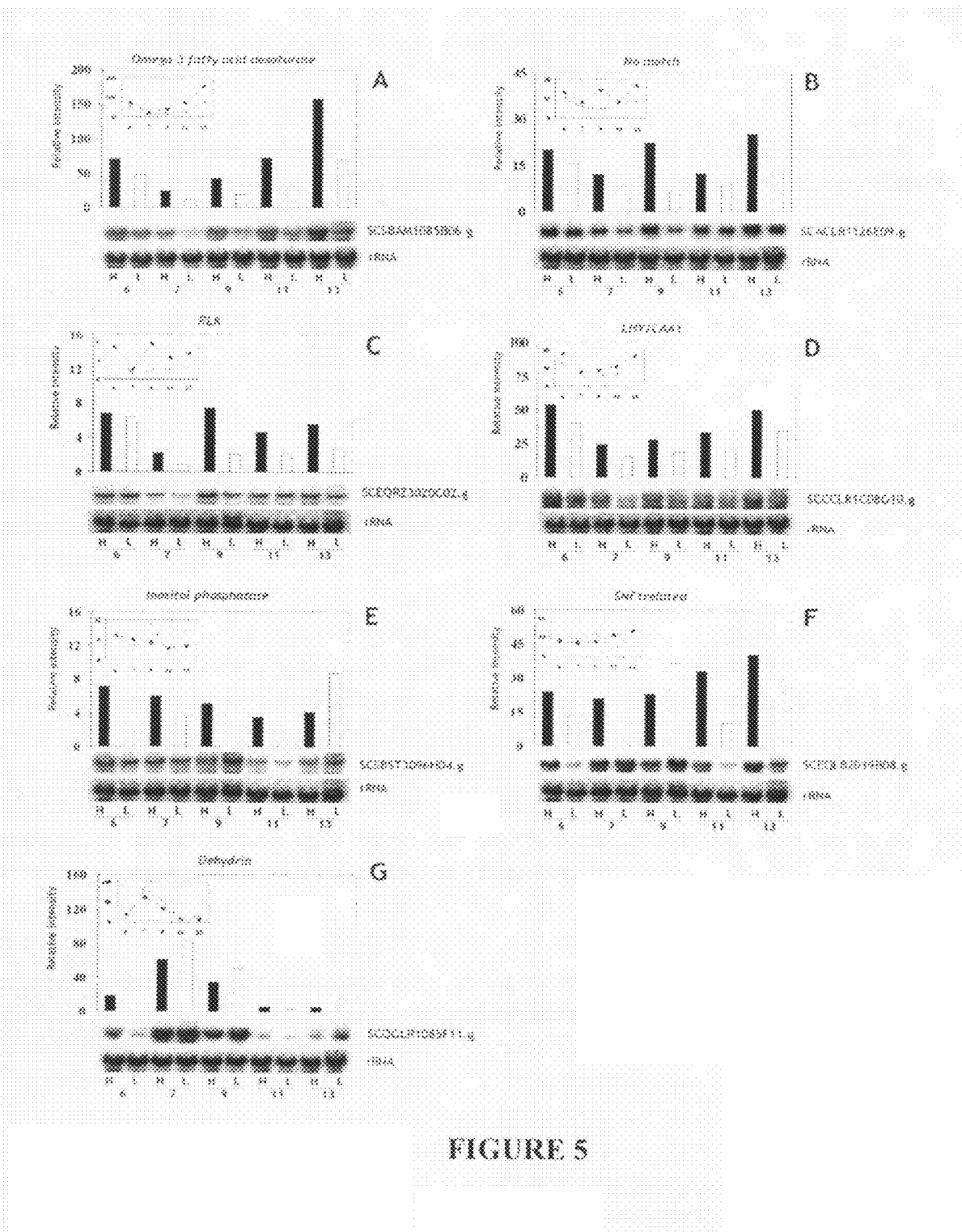
FIG. 5: Expression profiles of differentially expressed genes along the growing season. RNA-blots were prepared from total leaf-RNA from a pool of 7 individuals with high (HS) and low (LS) sugar content collected along the growing season (6, 7, 9, 11 and 13 months after planting). The inset graphs show the expression levels observed for the high (black circles) and low (white circles) sugar content plants. An rDNA fragment was used as a control.

To confirm gene expression trends along the growing season we determined the mRNA levels for the same seven genes in the 7HS (high sugar) and 7LS (low sugar) pools collected 6, 7, 9, 11 and 13 months after planting (FIG. 5). The inset graph represents the expression profile of each gene plotted for each population. The four genes found to be enriched in the high sugar content plants were consistently differentially expressed along the growing season (FIG. 5 *a-d*). These genes are possibly involved in the control of sucrose synthesis, accounting for the higher sugar content in these segregant plants. The genes with more transcripts in the low sugar content plants showed a less consistent pattern (FIG. 5 *e-g*). All of them were differentially expressed in the plants at nine months after planting, confirming the expression observed by microarrays, but only the one encoding dehydrin, a stress-related protein (FIG. 5*g*) had a more consistent pattern along the growing season.

Identity/Function of Differentially Expressed Genes The SAS represented in our array were chosen from 7381 genes catalogued by the SUCAST project (Papini-Terzi et al., 2005; Souza et al., 2001) and from the SUCAMET Catalogue of sugarcane metabolism genes available on the World Wide Web at sucest-fun.org). The SUCAST Catalogue includes Protein and Functional categories such as Receptors, Protein Kinases, Protein Phosphatases, Small GTPases, Transcription Factors, Calcium, Inositol, Ubiquitination, Hormone Biosynthesis, Development, Stress and Pathogenicity, among others. The catalogue also contains 548 SAS corresponding to hypothetical proteins or new genes for which no function can be inferred solely from the sequence or no similarity has been found to genes in public databases ('no matches'). The tissue-specificity of the selected genes has been evaluated in a previous work (Papini-Terzi et al., 2005), which revealed 217 genes with preferential expression in one of the six tissues analyzed (flowers, buds, leaves, roots, mature and immature internodes) and 153 highly ubiquitous genes.

Leaf mesophyll cells are the primary photosynthetic tissue, and photosynthate, mainly in the form of sucrose, is transported to meristems and developing organs. In sugarcane, growing young leaves and stem are the main carbohydrate-importing tissues. Source and sink tissues must be co-ordinately regulated at the level of gene expression and enzyme activity to produce rapid growth and efficient sucrose accumulation. Light and sugars regulate growth activities by a coordinated modulation of gene expression and enzyme activities in both, carbohydrate-exporting (source) and carbohydrate-importing (sink) tissues. Gene regulation is based on sensing different signals or stimuli, which then is transmitted through a signaling pathway that in the end leads to an increase or decrease of transcription. In sugar signaling, the first step is to sense the nature and level of the specific sugar. While elevated cellular levels of sugar up regulate genes involved in the synthesis of polysaccharides, storage proteins, pigments, as well as genes associated with defense responses and respiration, sugar deprivation enhances the expression of genes involved in photosynthesis and resource remobilization, such as the degradation of starch, lipid, and protein (Koch, 1996; Yu, 1999; Ho et al., 2001). Although the regulatory effect of sugars on photosynthetic activity and plant metabolism has long been recognized, the concept of sugars as central signaling molecules is relatively new (reviewed by Rolland et al., 2002).

In this work, we evaluated the expression levels of SUCAST and SUCAMET genes in four tissues (leaf, internodes 1, 5 and 9) from three sugarcane populations with contrasting sugar accumulation capacities and four commercial varieties. We describe a total of 203 SAS (Sequence ID Nos 1-203) differentially expressed between the high and low brix populations in at least one of the tissues analyzed (Tables V to IX). Two of them appeared differentially expressed in five of the samples analyzed, four in four, fourteen in three and thirty in two, totalling 50 genes for which transcripts are altered in more than one sample (Table X). The differentially expressed genes belong to several functional categories including calcium signalling, stress responses, transcription and ubiquitination. These genes and their variants can be used to predict sugar content from plants or generate plants with higher sucrose content.

TABLE X

Number of occurrences of differential expression for each SAS in all the samples analyzed.

| Occurrences | Number of SAS |
|---|---|
| 5 | 2 |
| 4 | 4 |
| 3 | 14 |
| 2 | 30 |
| 1 | 153 |

Since significant number of genes encoding SNF1 related-kinases were found differentially expressed (see below) we looked for differentially expressed genes encoding SNF1s and their regulators in commercial varieties that varied in sucrose content. Table XIV list several members of this family of proteins whose expression was found to be associated to sucrose content.

In an alternate approach, mature (Internode 9), intermediately mature (Internode 5) and immature (Internode 1) culm samples were compared. The aim of these comparisons was to reveal genes differentially expressed when internodes rich in sucrose were compared to the first internodes poor in sucrose. A total of 186 genes were identified as developmentally regulated during culm maturation (Tables XV to XX). Forty-six of them were also found to be differentially expressed in the direct comparisons between high and low brix and eighteen of them were altered in up to 5 of the samples analysed. Table XXI shows the 18 SAS found differentially expressed in at least two of the biological samples considered (the data regarding 14 of them were retrieved from Felix, 2006 as indicated in the Table). SEQ ID No:s 229-373 relate to the 140 SAS whose expression was altered in high sugar internodes which are not contained in the SEQS Nos 1-203 group. The data revealed by this experimental design indicates that the genes differentially expressed in high vs. low brix plants may have a role in culm maturation and may improve this process and consequently alter sucrose content if altered in transgenic plants.

There are several genes encoding protein kinases involved with the calcium signalling pathway altered in association with sucrose content. One (SCEQRT2099H01.g) is similar to members of the CDPK family (Calcium-dependent Protein Kinase) and nine others (SCACLR1036B06.g, SCBFSB1046D04.g, SCCCLR1C05B07.g, SCEQLB2019B08.g, SCMCRT2103B04.g, SCCCLR2C01G07.g, SCCCLB1002D12.g, SCEQRT2030G04.g, SCSGHR1070F12.g) to CIPKs (CBL-interacting protein kinases) from the SnRK3 subgroup of plant DNF-like protein kinases (Hrabak et al., 2000). An Arabidopsis CIPK14 has been shown to be induced by sucrose, and sucrose-responsive elements in its promoter have been identified (Lee et al., 2005). Several studies have reported that some CDPKs and SNRK (SNF1-related kinases) are able to phosphorylate and regulate the enzyme sucrose synthase (Hardin et al., 2003; Hardin et al., 2004; Huber et al., 1996; Zhang et al., 1999). Plant SNF1-related kinases are regulated by regulatory subunits AKINbetagamma (Lumbreras et al., 2001). We found two SAS coding for such SnRK putative regulatory subunits, SCEQLR1092H10.g and SCJFST1011B06.g, the latter being differentially expressed in seven of the samples analyzed. We also found a gene encoding a SnRK1 (SCJFRZ2032G01.g) down-regulated in mature internodes in relation to immature internodes. SnRK1 (SNF1-Related Protein Kinase-1) is a plant protein kinase with a catalytic domain similar to that of SNF1 (Sucrose Non-fermenting-1) of yeast and AMPK (AM-Pactivated protein kinase) of animals (Halford et al., 2003). Carraro et al., (2001) identified at least 22 sugarcane expressed sequence tag (EST) contigs encoding putative SnRKs in the SUCEST database. Studies led to the hypothesis that SnRK1 is activated in response to high intracellular sucrose and/or low intracellular glucose levels (Halford et al., 2003). The first plant protein to be identified as a substrate for SnRK1 was a HMG-CoA reductase in A. thaliana (Dale et al., 1995). Subsequently, two other important enzymes, SPS and NR were shown to be substrates for SnRK1 phosphorylation in Ser-binding sites. In both cases, phosphorylation results in inactivation of the enzyme, although the inactivation of NR and SPS also requires the binding of a 14-3-3 protein to the phosphorylation site (Bachmann et al., 1996; Moorhead et al., 1999).

Four genes encoding CIPKs were found to be differentially expressed when mature and immature internodes were compared (SCJFRZ2032C08.g, SCJLRT1023G09.g, SCCCLR1C05B07.g, SCJLRZ1023H04.g). Our published studies have also identified two additional genes encoding SNF1-related SnRK3 CIPKs (SCCCLR2C01G07.g and SCMCRT2103B04.g) that are differentially regulated when mature and immature sugarcane internodes are compared that corroborate the present data and confirm a role for SNF-related kinases and their regulators in sucrose synthesis and accumulation (Felix, 2006). Additionally, three genes encoding SNF1-related kinases similar to osmotic stress-related kinases (SCCCST1004A07.g, SCEPRZ1009C10.g and SCCCST1006B11.g) were also found to be differentially expressed.

CIPKs interact with Calcineurin B-like proteins (CBL) (Shi et al., 1999). We found six genes encoding CBLs in the SUCEST database and thirty-one CIPKs, twenty-four of which were analyzed in this work. A calreticulin (SCRFLR2037F09.g) and a calmodulin (SCUTST3152C08.g) were found to be enriched in LB immature internodes and leaves respectively, and five calmodulin-binding proteins to be up-regulated (SCCCAM0001A03.g, SCCCLR2C02D03.g, SCEZLB1012F10.g, SCAGLR1043F02.g, SCEQLR1007G03.g, SCCCCL3120G07.g). Calcium signalling is effected via changes of calcium concentration and calcium sensing proteins such as calmodulin, calcineurin and calreticulin (Sanders et al., 2002). The latter relay the signal downstream through phosphorylation cascades and changes in gene expression. Studies with the sucrose synthase from maize showed that phosphorylation of this enzyme at the residue Ser-15 by CDPKs stimulates its sucrose cleavage activity (Hardin et al., 2003; Huber et al., 1996). Moreover, CDPKs may phosphorylate at Ser-170 and target this enzyme for 26S-proteasome-dependent degradation (Hardin et al., 2003; Hardin & Huber, 1999). Sucrose synthase is related to several physiological processes, including sink/source relationships within the plant (Hanggi & Fleming, 2001; Zrenner et al., 1995) and may contribute to sucrose accumulation in sugarcane. Additionally, it has been shown that some calcium-dependent kinases can phosphorylate and inactivate sucrose-phosphate synthase, which has a key role in sucrose biosynthesis (McMichael et al., 1995; Pagnussat et al., 2002). Taken together, these results suggest that, as sucrose biosynthesis seems to be (at least partially) a SNF1- and calcium-regulated process, genes encoding the calcium-dependent kinases and SNF1-related protein kinases and their modulators differentially expressed in our study may represent critical points in the control of sucrose synthesis and accumulation in sugarcane. Consequently, these sugarcane genes can be used to increase sucrose content in transgenic plants.

Figure 8:
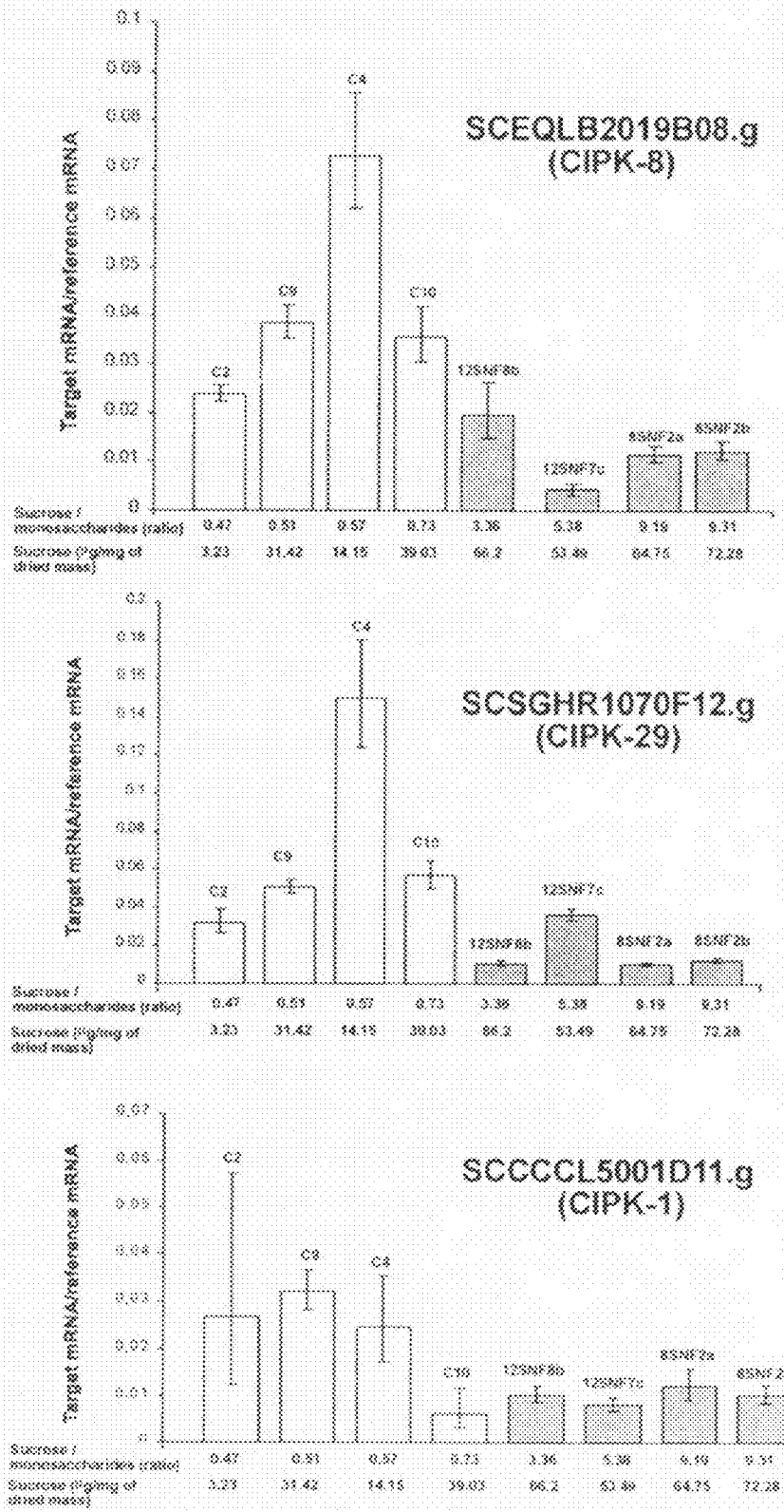
FIG. 8—Expression analysis of CIPK-8, CIPK-29 and CIPK-1 mRNA levels in control (blank) and transgenic plants (grey) of two-month old plants using quantitative PCR analysis. The bars show mRNA levels of CIPK8 (SCEQLB2019B08.g), CIPK29 (SCSGHR1070F12.g) and CIPK-1 (SCCCCL5001D11.g) relative to mRNA levels of the reference gene (SCQGAM2027G09.g). All reactions were carried out in parallel and each reaction was performed in triplicate. Error bars were calculated as described by Livak and Schmittgen (2001). The graph also shows sucrose levels and the ratio of sucrose to monosaccharides in these plants.

To confirm that differential gene expression associated to sucrose content was indeed reflecting a role for these genes in sucrose synthesis or accumulation we obtained sugarcane transgenic plants where the gene encoding CIPK-8 (SAS SCEQLB2019B08.g) was silenced by RNAi interference. Sugarcane embryonic callus from the cultivars SP80-185, SP94-3116, CTC1, SP83-2847, SP80-1842 and SP91-1049 were bombarded by biolistics with a construct where 331 bp of SAS SCEQLB2019B08.g (SEQ ID No. 378) was cloned in the sense and antisense orientation. The 331 bp fragment was obtained by PCR using the primers SNFL1 (SEQ ID No. 374): 5'-CCCTCTAGACTCGAG CATTCATTCCATTC-CGTTCC-3' and SNFL2 (SEQ ID No. 375): 5'-CCCAAGCT-TGAATTC CGCCACCAGTAGCAAATTCT-3'. The fragment was digested with the enzymes XhoI and EcoRI and cloned in the pHannibal vector (Wesley et al., 2001) digested with the same enzymes for the sense orientation. The same fragment was then digested with HindIII and XbaI and cloned in the vector already containing the sense construct digested with the same enzymes for the antisense orientation. FIG. 7 shows an alignment to two additional EST sequences encoding CIPKs (CIPK-29 SCSGHR1070F12.g and CIPK-1 SCCCCL5001D11.g) that are 95 and 85% identical, respectively, to the CIPK-8 fragment region amplified (red line) and show 65% overall identity when the three complete sequences are considered. CIPK-29 has also been identified as differentially expressed when high brix and low brix plants were compared using, cDNA microarrays. CIPK-1 was not detected by our array experiments as a differentially expressed gene. Transgenic plants were generated by co-transformation of the pHannibal-CIPK RNAi construct and the pHA9 vector (Wei and Albert, U.S. Pat. No. 6,706,948) which contains the maize ubi1 promoter driving a neomycin phosphotransferase II gene and NOS terminator. To verify that CIPK-8 mRNA levels were decreased in the transgenic plants obtained CIPK-8 mRNA levels were quantitated by Real-time PCR. 8 shows the mRNA levels for CIPK-8 in relation to the reference gene GAPDH. The real-time PCR primers used are listed in Table XII. Since CIPK-29 and CIPK-1 were very similar to CIPK-8 their mRNA levels were also measured in the transgenic plants. Leaves from four plants from cultivar SP94-3116 transformed with the CIPK-8 RNAi construct and four construct plants transformed with the empty vectors alone are shown. The data indicates successful silencing for the CIPK-8 gene when control and RNAi CIPK-8 plants are compared. The data also indicates that the construct introduced was able to silence the CIPK-29 and CIPK-1 genes as well. To confirm the increased sucrose content due to the silencing of the genes total and reductive sugar levels were determined by HPLC (high performance liquid chromatography). FIG. 8 indicates the sucrose levels in control and CIPK silenced plants as well as the ratio between sucrose to glucose+fructose. Silenced plants presented in average 64.18 μg of sucrose/mg of leaf dried weight while control plants presented 21.95 μg/mg. The ratio of sucrose/glucose+fructose was also altered. CIPK silenced plants presented a ratio of 6.81 of sucrose over the monosaccharides while the control plants showed an average ratio of 0.57. This may possibly indicate an overall 12 fold more efficient conversion of the monosaccharides glucose and fructose into sucrose in the leaves of silenced plants.

Since both CIPK-8 and CIPK-29 were found to be differentially expressed in sugarcane leaves we postulate that CIPK kinases regulate sucrose synthesis in sugarcane. Additionally, CIPKs may have a role in regulating sugar accumulation in the internode tissues since several of them were detected as differentially expressed in these organs. Since the fragment used to silence the differentially expressed CIPK-8 and CIPK-29 was also efficient in silencing CIPK-1, which has an overall identity to CIPK-8 and CIPK-29 of 65%, it is possible that the use of SNF1-related genes with identity to the genes protected in this patent, either to the whole genes, or fragments of the genes, of at least 65%, but not restricted to 65%, may also be able to silence the protected genes. The reverse scenario is also plausible. Since CIPK-1, a gene that was not detected in our microarray data as associated to sucrose content, was silenced by the CIPK-8 construct even though it presented only 65% sequence identity to its overall available sequence, it is possible to silence sucrose associated genes by using sequences from similar sucrose-unrelated genes.

Additional genes that may contribute to sucrose synthesis and accumulation are described below. We identified five genes encoding aquaporins among the differentially expressed genes when high brix and low brix plants were compared (SCCCLR1024C03.g, SCCCRZ1001F02.g, SCCCRZ1002E08.g, SCCCST3001H12.g, SCEQRT2100B02.g). In a previous work they were demonstrated to be down-regulated in the mature internodes (Felix, 2006). This large and diverse family of membrane proteins, also known as MIPs (Major Intrinsic Proteins) is primarily involved in the regulation of water movement between cells and cell compartments, although many of them also facilitate the passage of small solutes (rev. Maurel and Chrispeels, 2001; Chaumont et al, 2005). According to their subcellular localization, aquaporins can be classified as plasma membrane intrinsic proteins (PIPs) or tonoplast intrinsic proteins (TIPs). The aquaporins genes we identified as differentially expressed fall into both of these categories. The accumulation of sucrose in such high concentrations as seen in sugarcane cells certainly represents an osmotic challenge, which demands efficient control of solute compartmentation. As key players in the equilibration of water potentials via regulation of membrane permeability, aquaporins may have a fundamental role in the process of sugar storage in sugarcane vacuoles. It has been observed in *Arabidopsis* that loss of the aquaporin TIP1;1 severely affects carbohydrate metabolism and transport (Ma et al., 2004) and the authors postulate that this aquaporin could be involved in a vesicle-based routing of carbohydrates towards the central vacuole. Due to the diversity of roles described for the members of this family, additional experiments are necessary to elucidate the possible roles of these sugarcane aquaporins in the sugar accumulation process. Sugar-signaling pathways do not operate in isolation but are part of cellular regulatory networks. Recent results clearly show cross talk between different signaling systems, especially those of sugars, phytohormones, and light. Most of the stress-related genes are cold- and drought-induced; there is also a ribonuclease that appeared altered four times and a wound-induced protein differentially expressed in 5 samples. Four sugarcane stress-related ESTs belong to a class of low-molecular-weight hydrophobic proteins (LTI) involved in maintaining the integrity of the plasma membrane during cold, dehydration and salt stress conditions. These genes are activated by environmental factors, such as dehydration and salinity and by chemical signals such as abscisic acid (ABA) (Morsy et al., 2005).

Sixteen differentially expressed genes encode transcription factors. A putative AP2/EREBP transcription factor (SCBGLR1099G02.g) was shown to have enhanced expression in leaves from plants with high sugar content. AP2/EREBP form a family of plant-specific transcription factors that contains an AP2/EREBP (ethylene responsive element binding protein) domain, a conserved region of 60 aminoacids involved in DNA binding (Jofuku et al., 1994; Okamuro et al., 1993; Riechmann and Meyerowitz, 1998). AP2 transcription factors are involved in the specification of flower organ and meristem identity, and suppression of flower meristem indeterminacy (Bowman et al., 1989; Irish and Sussex, 1990; Kunst et al., 1989; Okamuro et al., 1993). AP2 is also required for ovule and seed coat development (Jofuku et al., 1994; Leon-Kloosterziel et al., 1994; Modrusan et al., 1994). Although the most remarkable function of AP2 is in flower development, its transcripts are also detected in leaves, stems, and seedlings (Jofuku et al., 1994), opening the possibility of diverse functions for different members of the AP2 family. It was already shown that ap2 mutations cause changes in the ratio of hexose to sucrose during seed development (Ohto et al., 2005). Because of this observation, it is believed that potential targets of AP2 activity may be enzymes involved in sugar metabolism.

We found eight CYP-related genes altered among the differentially expressed genes (SCEQRT1026H08.g, SCAGLR1043E04.g, SCUTAM2005B03.g, SCSGFL4193B05.g, SCACSB1037A07.g, SCEZHR1087F06.g, SCSGHR1069F04.b, SCQGHR1012B09.g). Cytochrome P450 monooxygenases (P450s) are used widely in plant biosynthetic and detoxicative pathways including synthesis of lignins, UV protectants, pigments, defense compounds, fatty acids, hormones, signaling molecules, breakdown of endogenous and toxic compounds (Schuler and Werck-Reichhart, 2003). During sugarcane internode maturation, parenchyma cells differentiate into highly specialized sucrose-storage compartments. This process imposes cellular reorganization to cope with osmotic and oxidative stress, and involves progressive lignification and suberization of cell walls to prevent pathogen invasion and water loss (Kolattukudy, 1984; Jacobsen et al., 1992), which may explain the predominance of stress-related genes (34 SAS) among the genes described in this work.

Eighteen differentially expressed SAS encode for hormone biosynthesis or hormone-related genes either when comparing the high brix against low brix plants or the high brix against low brix internodes (SCCCAM2004G02.g, SCCCCL6002B05.g, SCCCFL4091A07.g, SCCCLR1048D07.g, SCCCLR1C03G01.g, SCCCLR2002F08.g, SCCCRT1001E01.g, SCEQRT1024E12.g, SCEQRT1028H06.g, SCEZLB1009A09.g, SCJFRT1005C11.g, SCJFRT1007H07.g, SCRFLR1012D12.g, SCSBAM1085B06.g, SCSGAM1094D05.g, SCVPLR2012A10.g, SCVPRZ2038F04.g, SCVPRZ3025G09.g). Three encode for salicylic acid biosynthesis and six of them code for jasmonate biosynthesis genes. Two ESTs that were up regulated in high sugar content (HS) mature leaves codes for an omega-3 fatty acid desaturase-FAD8. In higher plants, the membrane lipids contain a high proportion of trienoic fatty acids (TAs). It has been suggested that these fatty acids, especially linolenic acid, are precursors of a defense-related signal molecule, jasmonate (JA). In *Arabidopsis*, three genes encoding the omega-3 fatty acid desaturase, namely FAD3, FAD7 and FAD8, are responsible for the production of TAs. Environmental stimuli, such as wounding, salt stress and pathogen invasion, which lead to a rapid increase in JA production, significantly induce expression of the FAD7 and FAD8 genes (Nishiuchi and Iba, 1998). The data points to a role of JA and salicylic acid synthesis in sucrose metabolism. This is the first report of the involvement of these hormones in sucrose synthesis.

Recent evidence suggests that plants have many different types of receptor-like protein kinases (RLKs) that may transduce extra cellular information into the cell. Twenty-one sugarcane SAS encoding for a RLK were found to be differentially enriched in the high sugar content plants and seventeen when mature and immature internodes were compared. RLKs have been identified from a number of plants and have been categorized into classes based on different structural motifs found in their extra cellular domains. The physiological functions of most RLKs are unknown, but some of them are involved in disease resistance and plant development (Becraft, 2002).

A SAS homologous to a gene encoding a Myb-repeat transcription factor (SCCCLR1C08G10.g), similar to CIRCADIAN CLOCK ASSOCIATED (CCA1) or LATE ELONGATED HYPOCOTYL (LHY), was up regulated in High Sugar mature leaves. CCA1/LHY and the TIMING OF CAB EXPRESSION 1 (TOC1) are thought to participate in a negative feedback loop, which is part of a model for the central oscillator in the *Arabidopsis* circadian clock. In higher plants the circadian clock controls hypocotyl elongation, daily leaf movements, flowering time and the rhythm of $CO_2$ fixation (McClung, 2001). A sugarcane LHY/CCA1 was found to be enriched in the high sugar content individuals and this expression profile was also observed throughout the growing season. In tomato, Jones and Ort (1997) have demonstrated that the circadian rhythm controls the timing of sucrose-phosphate synthase phosphatase activity, which in turn, determines the activation of sucrose phosphate synthase (SPS). SPS catalyses the conversion of UDP-glucose and fructose-6-phosphate to sucrose-6-phosphate, the second last step in sucrose biosynthesis (Huber and Huber, 1996). Pathre et al., (2004) demonstrated that the diurnal variation observed in the activity of SPS was not due to any intrinsic rhythm, but due to the transient changes in environmental conditions, like irradiance and temperature. When the circadian clock was correctly tuned with the environment, *Arabidopsis* plants presented increased photosynthesis and growth (Dodd et al., 2005). The sugarcane EST was mainly expressed in mature and immature leaves, lateral bud and flower, but also presented a weak expression in immature internodes and roots (not shown). We hypothesize that the expression profile of LHY/CCA1 transcripts in HS plants could be related to a photosynthetic advantage and, consequently, an enhanced carbon fixation. LHY/CCA1 may control the transcription of a protein phosphatase that subsequently activates the SPS enzyme, increasing sucrose synthesis.

Two SAS encoding for 14-3-3 proteins SCEQRT1025D06.g and SCEQRT1031D02.g) were found to be more expressed in mature leaves from the Low Sugar population and four to be down-regulated in mature internodes ((SCCCRZ1001D02.g, SCCCLR1022D05.g, SCEQRT1025D06.g, SCEQRT1031D02.g). Recent reports pointed out the importance of these adapter proteins in plant metabolic pathways (Ferl, 2004). It was suggested that the members of this family affect nitrate fixation by regulating nitrate reductase (NR) and carbohydrate metabolism by binding to SPS. This enzyme has several putative phosphorylation sites that regulate its activity by 14-3-3 dependent and independent mechanisms. Non-14-3-3 events include phosphorylation of SPS on Ser-424 and Ser-158 which is thought to be responsible for light/dark modulation and osmotic stress activation of the enzyme (McMichael et al., 1993; Toroser and Huber, 1997). However, there is a site-specific regulatory interaction between 14-3-3 proteins and Ser-229 of spinach SPS, which inhibits SPS activity (Toroser et al., 1998). This regulatory node is likely to be the same that occurs in the NR regulation. In its unphosphorylated state, SPS is active. Phosphorylation by a kinase (e.g. SNF1, Bachmann et al., 1996; Moorhead et al., 1999) does not inactivate SPS, but tags the enzyme for 14-3-3 binding, which completes the signal-induced transition toward inactivation. SPS that is phosphorylated and bound by 14-3-3s may be inactivated directly in a reversible manner or may be destabilized and subjected to proteolysis (Sehnke et al., 2002; Comparot et al., 2003). It has been reported that during sugar starvation targets for 14-3-3 proteins are degraded by proteases; the function of this is not clear but it was suggested to represent a safety valve for metabolic regulation (Cotelle et al., 2000). Various research groups reported the impact of 14-3-3 proteins on metabolism. Overexpression of 14-3-3 proteins in potato induced an increase in catecholamine and soluble sugars contents in leaves, whilst a 14-3-3 antisense experiment increased the tuber starch content, NR activity and amino acid composition (Prescha et al., 2001; Swiedrych et al., 2002). In addition, Zuk et al., (2003) observed a significant increase in potato SPS and NR activities when all of the six 14-3-3 isoforms were repressed.

There are three enzymes involved on the biosynthetic pathway of lignin: cinnamoyl-coenzyme A reductase (CCR), cinnamyl alcohol dehydrogenase (CAD) and caffeic acid 3-O-methyltransferase (COMT). A SAS coding for a COMT (SCRFLR1012F12.g) was found to be differentially expressed in four different samples. Lignins are phenolic polymers found in the secondary cell walls of vascular plants. They play an important role by reducing the permeability of the cell wall to water and provide mechanical strength and defense against wounding and infection (Lewis and Yamamoto, 1990). The importance of lignin biosynthesis as dominant process in maturing sugarcane stems was observed by Casu et al., (2004). The storage parenchyma of the sugarcane maturing stem internodes is extensively lignified and Jacobsen et al., (1992) proposed that this process parallels to the increase in sucrose content observed in matures internodes. This lignification could provide defense against wounding and infection for these plants. Low lignin levels could, on the other hand, lead to high sucrose accumulation, or COMT could have an additional function in sucrose synthesis or accumulation that has not been previously identified. To test for this hypothesis and confirm that COMT differential gene expression associated to sucrose content was indeed reflecting a role for these genes in sucrose synthesis or accumulation we obtained sugarcane transgenic plants where SAS SCRFLR1012F12.g was silenced by antisense expression.

Figure 9:
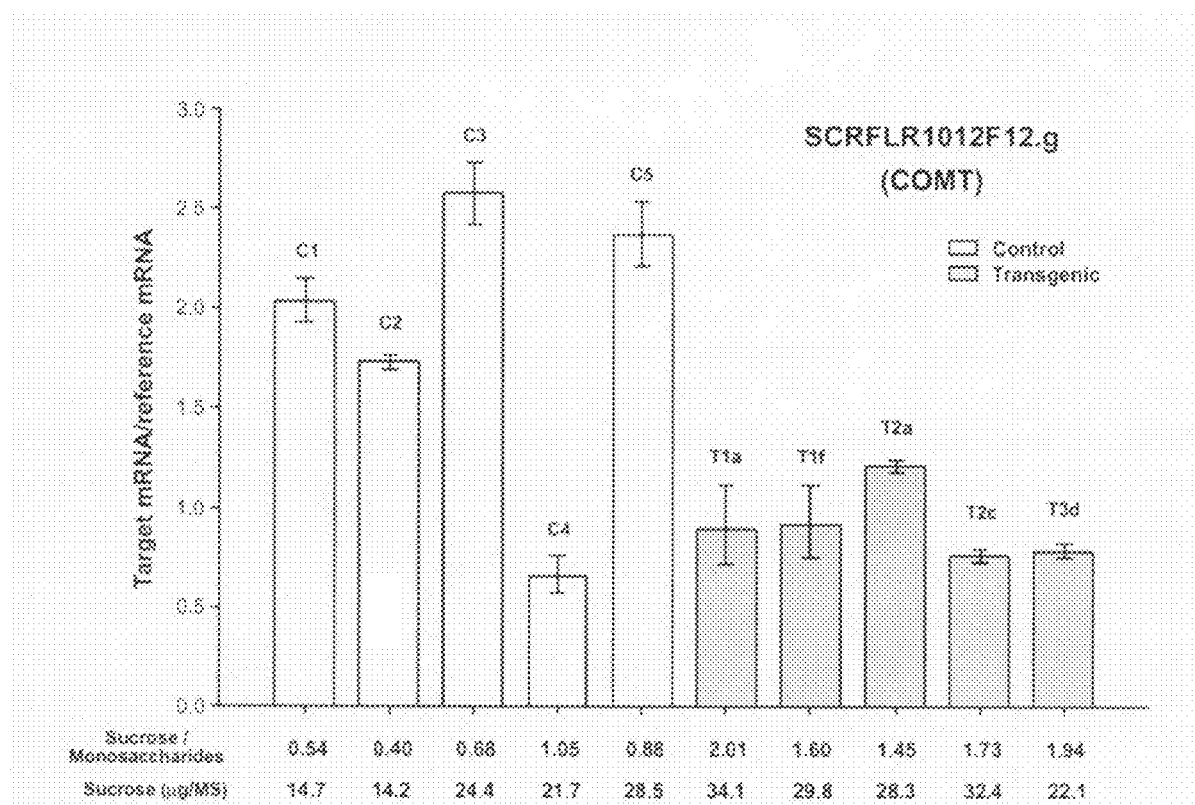
FIG. 9—Expression analysis of COMT mRNA levels in control (blank) and transgenic plants (grey) of two-month old plants using quantitative PCR analysis. The bars show mRNA levels of COMT (SCRFLR1012F12.g) relative to mRNA levels of the reference gene (SCQGAM2027G09.g). All reactions were carried out in parallel and each reaction was performed in triplicate. Error bars were calculated as described by Livak and Schmittgen (2001). The graph also shows sucrose levels and the ratio of sucrose to monosaccharides in these plants.

Sugarcane embryonic callus from the cultivars SP83-2847, SP91-1049, SP80-185, CTC1 and CTC5 were bombarded by biolistics with a construct where a 535 bp fragment of SAS SCRFLR1012F12.g (SEQ ID No. 380) was cloned in the antisense orientation in the BamHI site of vector pAHC17. The 535 bp fragment was obtained by PCR using the primers COMT(AS)pAHC17 forward (SEQ ID No. 376): 5'CGCG-GATCCGACGTCGTCAAGTGCCAGAT3' and COMT (AS)pAHC17 reverse (SEQ ID No. 377): 5'CGGGATC-CGCGTTGGCGTAGATGTAGGT3'. The fragment was digested with the enzyme BamHI, cloned in the pAHC17 vector (Christensen and Quail, 1996) digested with the same enzyme and clones were sequenced to identify a construct where the insert was in the antisense orientation. Transgenic plants were generated by co-transformation of COMT(AS)/pAHC17 construct and the pHA9 vector (Wei and Albert, U.S. Pat. No. 6,706,948). To verify that COMT SCRFLR1012F12.g mRNA levels were decreased in the transgenic plants obtained COMT mRNA levels were quantitated by Real-time PCR. FIG. 9 shows the mRNA levels for SCRFLR012F12.g in relation to the reference gene GAPDH in plants of variety SP83-2847 transformed with the COMT (AS/pAHC17 construct. The real-time PCR primers used are listed in Table XII. Leaves from five plants transformed with the COMT antisense construct and five plants transformed with the vectors alone are shown. The data indicates successful silencing for the COMT gene when control and antisense plants are compared. To check if silencing of the genes would lead to increased sucrose content, total and reductive sugar levels were determined by HPLC (high performance liquid chromatography). FIG. 9 indicates the sucrose levels in control and COMT silenced plants as well as the ratio between sucrose to glucose+fructose. Silenced plants presented in average 29.34 μg of sucrose/mg of leaf dried weight while control plants presented 20.7 μg/mg. The ratio of sucrose/glucose+fructose was also altered. COMT silenced plants presented a ratio of 1.74 of sucrose over the monosaccharides while the control plants showed an average ratio of 0.71. This may possibly indicate an overall 2.4 fold more efficient conversion of the monosaccharides glucose and fructose into sucrose in the leaves of silenced plants.

Signals can be perceived and amplified at the cell membrane by receptors coupled to a variety of signaling pathways, including the inositol 1,4,5-trisphosphate (IP3) pathway. This second messenger is produced from the hydrolysis of phosphatidylinositol 4,5 bisphosphate and raises $Ca^{2+}$ levels in the cytosol (Berridge, 1993). The inositol-polyphosphate 5-phosphatase (5Ptases) comprise a large group of enzymes that can hydrolyze 5-phosphates from a variety of inositol phosphates, like IP3 (Majerus et al., 1999). There are four genes encoding inositol metabolism enzymes altered in our data (SCRULB1060F05.g, SCSBST3096H04.g, SCCCLR1C02F07.g, SCCCRZ2001A10.g) when high brix and low brix plants were compared and a Phospholipase C(SCSBHR1052C05.g) down-regulated in sugar-rich internodes. Inositol derivatives may be involved in the modulation of $Ca^{2+}$ levels and there are many evidences for a role of $Ca^{2+}$ in sugar signaling (reviewed by Rolland et al., 2002, see above).

In sugarcane, the use of wild ancestors as a means to incorporate new traits or to improve variability in a well established breeding program is something that requires a lot of attention and caution from the breeder. Such parents can carry a large proportion of variation inferior to current commercial hybrids, and sugar content is likely to be poor. The crosses and selections done in this study aimed to produce sugar content variability, introducing new genes that exist in wild ancestors and that had never been explored in the development of hybrid commercial varieties. The final objective was, once a large variability was created from the introgression studies, to perform bulk segregation analysis in extremes of the population to eventually identify genes that could be linked to sugar content. The markers identified in this work have been shown to be useful to analyze crosses between individuals from the introgression study and elite cultivars and follow the sugar content genes coming from wild ancestors.

It is worth to mention that the use of wild germplasm from 21 S. officinarum and 13 S. spontaneum genotypes allowed the selection of more divergent materials than the crosses between the commercial varieties. The range of brix content from 8.6 (the extreme individual for LB) to 23.9 (the extreme individual for HB) could never be reached using progeny derived from conventional crosses. This is a valuable population for using in sucrose accumulation studies. The results produced are probably different from the ones that could be obtained with populations derived from crosses between commercial varieties, with higher brix content but not so contrasting phenotypes.

The approach described produced data and molecular markers to be used in breeding programs, in the characterization of transgenic plants designed to contain more sucrose, and/or used as candidate genes for genetic manipulation in transgenic plants or non-transgenic plants in order to improve the sugar content of commercial varieties. Changes in more than one gene expression are more significant while changes in three or a higher number of genes are highly significant when searching for molecular markers but a pattern of expression of just one gene was shown to be useful in characterizing a plant or population of plants in regards to sucrose content. Additionally, silencing of two genes differentially expressed by RNA interference and antisense expression proved useful in the development of transgenic plants with increased sucrose content. It is very likely that changes in transcript levels are accompanied by changes in the protein levels encoded by the genes, thus quantification of the corresponding proteins may also be used to identify plants with contrasting sucrose accumulation capacities. Measures of sucrose content can accompany gene expression measures and be complementary in defining plants with gene expression favorable to sucrose accumulation. These individuals may be crossed and rounds of selection with the aid of the markers can follow each generation to yield better sucrose producing plants.

TABLE XIII

List of Sugarcane Assembled Sequences (SAS) and their SEQ ID Nos.
The EST Genbank accession number is in parentheses. The SEQ ID No. refers to the sequence identifiers in the sequence listing. The listed ESTs assembled to the indicated sequence and should be considered one transcript. Each SAS is differentially expressed between plants with low and high sucrose content or between internode tissues of high and low sucrose content.

SEQ ID No. 229: SCACLR1057C07.g
(CA073791, CA220104, CA175807, CA173305, CA161664,
CA208707, CA275831, CA082360, CA232127, CA208522,
CA082500, CA158772, CA254078, CA154812, CA168711,
CA265487, CA216423, CA082097, CA282869, CA163131,
CA242148, CA116387, CA088301, CA205272, CA216758,
CA083652, CA178498, CA275830, CA164981, CA173335,
CA257615, CA239707, CA164577, CA085299, CA209305,
CA191774, CA082901, CA206163, CA219544, CA256136,

TABLE XIII-continued

List of Sugarcane Assembled Sequences (SAS) and their SEQ ID Nos.
The EST Genbank accession number is in parentheses. The SEQ ID No. refers to the sequence identifiers in the sequence listing. The listed ESTs assembled to the indicated sequence and should be considered one transcript. Each SAS is differentially expressed between plants with low and high sucrose content or between internode tissues of high and low sucrose content.

CA242861, CA087944, CA219617, CA172548, CA089365,
CA242929, CA296024, CA211326, CA077845, CA065159,
CA220037, CA078282, CA176305, CA087014)

SEQ ID No. 230: SCACLR1130D02.g
(CA100457, CA108544, CA104245, CA139305, CA183555,
CA184261, CA075000, CA116753, CA124475, CA107618)

SEQ ID No. 231: SCACLR1130H08.g
(CA285355, CA296620, CA190345, CA236470, CA199128,
CA223158, CA296543, CA237253, CA116793, CA223246,
CA275687)

SEQ ID No. 232: SCACLR2022H05.g
(CA185596, CA107538, CA278239, CA142728, CA095392,
CA190254, CA255382, CA118885, CA186426, CA242032,
CA083853, CA088965, CA186503, CA072676, CA246552,
CA088959, CA292397, CA269566, CA163748, CA243048,
CA287796, CA095283, CA194496, CA285226, CA102940,
CA265718, CA242052, CA194677, CA157478, CA238095,
CA282663, CA127731, CA104186)

SEQ ID No. 233: SCAGLR1021G10.g
(CA184947, CA241174, CA116948, CA235280, CA148829,
CA187937, CA290068, CA148916, CA253948, CA153438,
CA200242, CA288775, CA242709, CA242784, CA147421,
CA150935, CA110552, CA234507, CA277424, CA072428,
CA220958, CA221034, CA261229, CA220980, CA225630,
CA215861, CA229847, CA275017, CA229919, CA227414,
CA289769, CA239844, CA184991)

SEQ ID No. 234: SCBFAD1046D01.g
(CA284358, CA285672, CA258515, CA260599, CA285724,
CA284423, CA065523, CA269123)

SEQ ID No. 235: SCBGFL3095D08.g
(CA230968, CA243310, CA230887)

SEQ ID No. 236: SCBGFL4052C11.g
(CA221542, CA181746)

SEQ ID No. 237: SCBGFL4053F12.g
(CA219396, CA221898)

SEQ ID No. 238: SCBGLR1096C08.g
(CA190075, CA236012, CA290681, CA281821, CA111779,
CA102557, CA224586, CA290611, CA245672, CA118621,
CA219281, CA212792, CA118254, CA239357, CA123219,
CA245691)

SEQ ID No. 239: SCBGLR1117A05.g
(CA069967, CA206454, CA115471, CA222775, CA300103,
CA216451, CA069882, CA240610, CA121419, CA253181,
CA119047)

SEQ ID No. 240: SCCCCL2001B01.b
(CA075874, CA110039, CA262153, CA138938, CA222746,
CA206852, CA195629, CA065975, CA111213, CA243704,
CA139758, CA067579, CA228104, CA112899, CA219971,
CA159289, CA067652, CA243309, CA260244, CA136110,
CA260251, CA265770, CA207439, CA141173, CA260652,
CA108966, CA233446, CA109052, CA266455, CA264812,
CA196943, CA065789, CA204592, CA065874, CA228837,
CA267875, CA067584, CA114662, CA219472, CA219452,
CA067658, CA093038, CA235273)

SEQ ID No. 241: SCCCCL4003D08.g
(CA064615, CA239044, CA246974, CA074795, CA290714,

TABLE XIII-continued

List of Sugarcane Assembled Sequences (SAS) and their SEQ ID Nos.
The EST Genbank accession number is in parentheses. The SEQ ID No. refers to the sequence identifiers in the sequence listing. The listed ESTs assembled to the indicated sequence and should be considered one transcript. Each SAS is differentially expressed between plants with low and high sucrose content or between internode tissues of high and low sucrose content.

CA074872, CA094033, CA095138, CA183882, CA249457, CA102981, CA172565, CA263531, CA183925, CA255937, CA084305, CA285149, CA085127, CA228150, CA248344, CA064616, CA290646)

SEQ ID No. 242: SCCCCL4004A10.g
(CA101534, CA147302, CA227522, CA219008, CA114047, CA177473, CA250309, CA131850, CA222728, CA096239, CA121915, CA209925, CA174118, CA158138, CA264731, CA219404, CA241947, CA239850, CA139416, CA088821, CA149323, CA075509, CA192414, CA168488, CA070307, CA191927, CA227992, CA191529, CA267246, CA213285, CA250111, CA258031, CA224522, CA122970, CA072224, CA082052, CA098902, CA098895, CA094073, CA296040, CA238636, CA098164, CA237674)

SEQ ID No. 243: SCCCCL4004C06.g
(CA184820, CA224856, CA126504, CA232891, CA206438, CA212819, CA232897, CA214257, CA101169, CA082190, CA167693, CA214057, CA300033, CA094090, CA252628, CA167758, CA111995, CA074267, CA228379, CA211130, CA249343, CA209709, CA085064, CA202861, CA119928, CA225134, CA164339, CA225122)

SEQ ID No. 244: SCCCCL4007H07.g
(CA259044, CA299572, CA172510, CA266911, CA094384, CA217028, CA119215, CA269647, CA187053, CA288923, CA172798, CA216961, CA180079, CA300646, CA298791)

SEQ ID No. 245: SCCCCL5002B10.g
(CA221338, CA161278, CA221548, CA126743, CA176053, CA095223, CA158980, CA175702, CA137305, CA108318)

SEQ ID No. 246: SCCCCL5004D02.g
(CA192143, CA236211, CA277456, CA238363, CA207316, CA083476, CA300881, CA105556, CA167444, CA195960, CA101127, CA174295, CA171982, CA179165, CA082796, CA095389, CA299706, CA235517, CA171513, CA297597, CA079747, CA159787, CA097371, CA079116)

SEQ ID No. 247: SCCCFL4091A07.g
(CA223439, CA251804, CA235024)

SEQ ID No. 248: SCCCHR1004D03.g
(CA286507, CA215612, CA183433, CA065784, CA175929, CA102729, CA205573, CA264021, CA158422)

SEQ ID No. 249: SCCCHR1004H09.g
(CA198695, CA218094, CA240658, CA183261, CA257018, CA185072, CA107735, CA165864, CA162193, CA280279, CA102770, CA238555, CA267028, CA131832, CA257098)

SEQ ID No. 250: SCCCLB1023E12.g
(CA179300, CA198187, CA088499, CA224987, CA116260, CA238936, CA132328, CA210346, CA300142, CA158693, CA092253, CA271421, CA241178, CA182283, CA089207, CA194934, CA092199, CA296333, CA075354, CA224675, CA084007, CA113237, CA296334, CA066934, CA136894, CA192584, CA111805, CA067884, CA211313, CA216712, CA092778, CA066873, CA098107, CA280346, CA144921)

SEQ ID No. 251: SCCCLB2004C08.g
(CA279906, CA261059)

SEQ ID No. 252: SCCCLR1001D10.g
(CA249418, CA083581, CA252565, CA087780, CA126329, CA116150, CA256293, CA189955, CA208608, CA189961, CA239503, CA122010, CA180875, CA107889, CA265080,
CA154811, CA250574, CA288166, CA276490, CA203244, CA208413, CA209900, CA124777, CA289690)

SEQ ID No. 253: SCCCLR1022D05.g
(CA199003, CA295779, CA243427, CA242039, CA202852, CA128804, CA079318, CA079910, CA281772, CA281793, CA250251, CA140942, CA081545, CA084937, CA074621, CA106617, CA181947, CA091378, CA247107, CA140865, CA148961, CA086118, CA235025, CA111400, CA130075, CA114483, CA193046, CA087052, CA275872, CA119131, CA224651, CA240046, CA295949, CA255246, CA231690, CA222739, CA130833, CA189913, CA216812, CA152690, CA129200, CA094241, CA087758, CA300112, CA099509, CA295694, CA152604, CA289169, CA275873, CA100849, CA151157, CA278748, CA126737, CA219267, CA143476, CA217366, CA188937, CA149217, CA129933, CA230200, CA088938, CA121701, CA110053, CA143403, CA217293, CA276362, CA230113, CA155717, CA228428, CA066322, CA148305, CA273294, CA125293, CA279142, CA133423, CA190364, CA241302, CA109003, CA171238, CA124306, CA288895, CA152905, CA137901, CA241224, CA171157, CA189103, CA073313, CA280288, CA222537, CA244293, CA195698, CA284927, CA244221, CA240565, CA131978, CA143850, CA147045, CA116042, CA273851, CA118529, CA250276, CA114167, CA092744, CA111595, CA082835, CA283118, CA119664, CA090489, CA243388, CA139738, CA198502, CA074106, CA241811, CA193935, CA090417, CA144601, CA242944, CA263741, CA242878, CA181943, CA100925, CA154899, CA255036, CA298711, CA255877, CA231477, CA301130, CA079473, CA293695, CA249587, CA201652, CA270939, CA092502, CA231391, CA142524, CA293643, CA155896, CA272121, CA148488, CA249518, CA295765, CA227150, CA169631, CA100111, CA173458, CA219272, CA067413, CA086035, CA169552, CA238069, CA227079, CA101601, CA280785, CA264367, CA118824, CA220340, CA116614, CA118307, CA072726, CA255181, CA143851, CA128705, CA142362, CA230449, CA131091, CA251477, CA151152, CA192477, CA124603, CA092380, CA126294, CA071894, CA300717, CA179264, CA233938, CA126045, CA293018, CA283292, CA168278, CA162958, CA202235, CA266711, CA131176, CA119234, CA111790, CA232293, CA175336, CA092372, CA232205, CA247106, CA117673, CA297133, CA073144, CA227288, CA150142, CA297060, CA139824, CA205064, CA116036, CA202889, CA215601, CA296581, CA119907, CA144265, CA192882, CA298102, CA198270, CA216807, CA182514, CA128480, CA105914, CA108571, CA177022, CA232110, CA128410, CA125896, CA232195, CA289717, CA295716, CA301502)

SEQ ID No. 254: SCCCLR1022H07.g
(CA256002, CA153512, CA119708, CA201590, CA232582, CA203039)

SEQ ID No. 255: SCCCLR1024E11.g
(CA236213, CA119421, CA239312, CA087963, CA236209, CA093728, CA121529, CA144287, CA110967, CA120342, CA078164)

SEQ ID No. 256: SCCCLR1024F10.g
(CA248370, CA191668, CA174627, CA136231, CA240508, CA146036, CA228222, CA220265, CA237574, CA268651, CA242965, CA146965, CA237607, CA243057, CA268723, CA266000, CA163172, CA150009, CA235949, CA119432, CA132957, CA153279, CA074733, CA155267, CA134767, CA153353, CA208681, CA074819, CA174997, CA294180, CA298533, CA251324, CA105997, CA066993, CA203286, CA291734, CA274193, CA071109, CA071088, CA249083, CA208769, CA177604, CA106088, CA067069)

TABLE XIII-continued

List of Sugarcane Assembled Sequences (SAS) and
their SEQ ID Nos.
The EST Genbank accession number is in parentheses. The SEQ ID No. refers to the sequence
identifiers in the sequence listing. The listed
ESTs assembled to the indicated sequence and
should be considered one transcript. Each SAS is
differentially expressed between plants with low
and high sucrose content or between internode
tissues of high and low sucrose content.

SEQ ID No. 257: SCCCLR1068G11.g
(CA132953, CA232759, CA292317, CA213697, CA232845,
CA242579, CA071844, CA133612, CA213781, CA124103,
CA281045, CA243542, CA268384, CA080234, CA228260,
CA112544, CA220447, CA238600, CA120333, CA130280,
CA222523, CA085868, CA238048, CA289325, CA085954,
CA289237, CA290116, CA252889, CA230658, CA175174,
CA133538, CA246442, CA230739, CA133616, CA111266,
CA080878, CA127449, CA113622, CA130344, CA225351,
CA239513, CA206259, CA289382, CA246811, CA191694,
CA129517, CA257025, CA108272, CA257105, CA089953,
CA082439, CA285102, CA090031, CA220448, CA120037,
CA296110, CA233332, CA189423, CA246856, CA247427,
CA116596, CA233412, CA246807, CA224412, CA299018,
CA126355, CA221362, CA298715, CA128521, CA077715,
CA242434, CA071472, CA128603, CA071560, CA123524,
CA236982, CA139104, CA120188, CA248016)

SEQ ID No. 258: SCCCLR1072E03.g
(CA149803, CA140849, CA154999, CA217167, CA149970,
CA197516, CA179657, CA113459, CA205466, CA299206,
CA119586)

SEQ ID No. 259: SCCCLR1072H06.g
(CA293008, CA292012, CA208082, CA212163, CA095120,
CA250666, CA095061, CA250751 CA266742, CA140748,
CA299559, CA221625, CA199195, CA280252, CA249305,
CA283511, CA119620, CA273507, CA284119)

SEQ ID No. 260: SCCCLR1C04E03.g
(CA295762, CA246851, CA247540, CA295704, CA250739,
CA076585, CA129498, CA250812, CA189759, CA153500,
CA182502, CA273004, CA180831, CA225947, CA295943,
CA137602, CA283935, CA137601, CA225870, CA276088,
CA239790, CA125960, CA283930, CA085833, CA236700,
CA129446, CA206958, CA219091, CA204694, CA114854,
CA164705, CA133070, CA264948, CA076438, CA151018,
CA121378, CA288667, CA166549, CA127343, CA076524,
CA120880, CA267188, CA205607, CA228116, CA137280,
CA117418, CA237518, CA182380, CA235506, CA203663,
CA075662, CA113908, CA202142, CA156760, CA117805,
CA156119)

SEQ ID No. 261: SCCCLR1C07B07.g
(CA281556, CA102608, CA183206, CA267464, CA216559,
CA126478, CA178227, CA224781, CA220964, CA230932,
CA196879, CA111576, CA159229, CA285341, CA284646,
CA159313, CA267717, CA089742, CA228165, CA120559,
CA267804, CA296594, CA117476, CA283020, CA291172,
CA296665, CA280265, CA248548, CA090139, CA141203,
CA131303, CA142862, CA269709, CA074994, CA141285,
CA106243, CA141103, CA189990, CA266648, CA120035,
CA134522, CA157584, CA118179, CA243432, CA210686,
CA238135, CA248480, CA127949, CA290279, CA178232,
CA290337, CA279227, CA148788, CA277386, CA292004,
CA163922, CA248059, CA148876, CA216395, CA163999,
CA249878, CA222979, CA080867, CA288178, CA267417,
CA113988, CA112566, CA225163, CA249795, CA224169,
CA267504, CA160144, CA199747, CA296541, CA207876,
CA173201, CA127744, CA257183, CA270601, CA186974,
CA244929, CA121034, CA245946, CA094024, CA249521,
CA257253, CA165727, CA270682, CA109618, CA165164,
CA137020, CA283548, CA274874, CA165279, CA281754,
CA280871, CA079423, CA238032, CA228443, CA157012)

SEQ ID No. 262: SCCCLR2001E10.g
(CA262799, CA127278, CA280201, CA287309, CA089562,
CA078214, CA077866, CA287533, CA211102, CA180904,
CA089473, CA074528, CA079677, CA082818, CA118437,
CA269971, CA092559, CA247542, CA285807, CA091331,
CA277276, CA271301, CA072671, CA263353, CA205812,
CA280164, CA116982, CA073860, CA263266, CA116704,
CA089413, CA158170, CA173734, CA180319, CA163659,
CA163766, CA124561, CA278597, CA072426, CA178645,
CA271786, CA264556, CA120664, CA112499, CA185831,
CA084497, CA160409, CA083810, CA113314, CA160061,
CA187809, CA189668, CA238848, CA163841, CA114235,
CA165641, CA121314, CA129676, CA263145, CA279135,
CA177340, CA174900, CA152748, CA102472, CA112114,
CA188798, CA077061, CA185135, CA077762, CA116858,
CA178901, CA147468, CA188663, CA177888, CA274039,
CA118008, CA273237, CA174048, CA264113, CA088386,
CA281646, CA157750, CA190335, CA175668, CA270524,
CA154487, CA121143, CA180710, CA181093, CA091054,
CA127015, CA187162, CA092675, CA291128, CA106777,
CA088977)

SEQ ID No. 263: SCCCLR2002D04.g
(CA074921, CA117323, CA243313, CA211783, CA127099,
CA286494, CA075012, CA073105, CA128761, CA128376,
CA128367, CA243946, CA122696, CA128446, CA230627,
CA198414, CA298411, CA122974, CA238383, CA216280,
CA230711, CA209970, CA118723, CA241869, CA123055,
CA088133, CA241946, CA125071, CA124739, CA240999,
CA119298, CA080587, CA112133, CA270423, CA241082,
CA292850, CA114123, CA226786, CA257737, CA149929,
CA120520, CA202694, CA120498, CA123517, CA073839)

SEQ ID No. 264: SCCCLR2002G09.g
(CA116535, CA124657, CA116605, CA116498, CA072958,
CA257354, CA247799, CA235108, CA103542, CA112157,
CA224839, CA257438, CA123168, CA252080, CA080895,
CA102459, CA238997, CA081185, CA236648, CA078277,
CA081264, CA112560, CA112156, CA239544, CA125043,
CA088777, CA248898, CA118825, CA107504, CA118646,
CA248977, CA140223, CA203859, CA115827, CA103133,
CA115782, CA122771, CA074515, CA229803, CA116712,
CA123493, CA085075, CA122840, CA073424, CA229900,
CA200897, CA073545, CA115514, CA072446, CA232187,
CA072969, CA110011, CA073999, CA245664, CA298980,
CA125253, CA072002, CA213810, CA190056, CA230875,
CA115022, CA101040, CA230956, CA228508, CA280886,
CA102455, CA245446, CA126608, CA245426, CA097164,
CA243299, CA116857, CA140025, CA257680, CA101571,
CA116664, CA130312, CA105336, CA129039, CA256731,
CA095294, CA256654, CA110599, CA073864, CA115403,
CA127138, CA227390)

SEQ ID No. 265: SCCCLR2C03D05.g
(CA147771, CA241187, CA239901, CA282278, CA280090,
CA263518, CA278293, CA187784, CA242098, CA244500,
CA117444, CA243119, CA220678, CA181765, CA163903,
CA182831, CA154699, CA250434, CA142468, CA127482,
CA115131, CA226443, CA230328, CA129679, CA250352,
CA272571, CA121245, CA246334, CA263117, CA247571,
CA186969, CA152166, CA198196, CA112365, CA257624,
CA204733, CA194041, CA181847, CA155624, CA240278,
CA201864, CA181440, CA277850, CA181770, CA230413,
CA128431, CA142473, CA187851, CA163982, CA128359,
CA129154, CA153759, CA163714, CA129531, CA167236,
CA226189, CA287855, CA203879, CA274284, CA260310,
CA124731)

SEQ ID No. 266: SCCCRT1001E12.g
(CA262088, CA264485, CA209806, CA114408, CA194065,
CA206359, CA254730, CA178254, CA166387, CA132375,

TABLE XIII-continued

List of Sugarcane Assembled Sequences (SAS) and their SEQ ID Nos.
The EST Genbank accession number is in parentheses. The SEQ ID No. refers to the sequence identifiers in the sequence listing. The listed ESTs assembled to the indicated sequence and should be considered one transcript. Each SAS is differentially expressed between plants with low and high sucrose content or between internode tissues of high and low sucrose content.

CA092696, CA092563, CA126173, CA092562, CA190880, CA170137, CA102870, CA190269, CA119262, CA089823, CA213508, CA144221, CA183640, CA130410, CA064605, CA298178)

SEQ ID No. 267: SCCCRT2001H11.g
(CA236346, CA191174, CA300423, CA105281, CA230838, CA137439, CA200619, CA195246, CA213844, CA181724, CA108176, CA092614, CA228948, CA200693, CA203186, CA209467, CA187262, CA240256, CA241667, CA299526, CA262309, CA143552, CA295095, CA254981, CA220456, CA236075, CA235832, CA300428, CA250139, CA254632, CA243208, CA293154, CA294205, CA250212, CA269402, CA261591, CA294137, CA201093, CA243170, CA291895, CA256863, CA256942, CA166864, CA241994, CA182531, CA254163, CA196827, CA137128, CA262306, CA073149, CA245330)

SEQ ID No. 268: SCCCRT2002B03.g
(CA220568, CA243112, CA230852, CA160770, CA180268, CA272704, CA230939, CA137141, CA244400)

SEQ ID No. 269: SCCCRZ1001A09.g
(CA212821, CA074667, CA146782, CA272930, CA107169, CA260410)

SEQ ID No. 270: SCCCRZ1001C12.g
(CA117861, CA182890, CA138133, CA096667, CA183036, CA276095, CA167830, CA099489, CA192252, CA137344, CA125255, CA251500, CA229153, CA082252, CA111079, CA181249, CA071519, CA298523, CA198397, CA146190, CA180974, CA071438, CA170017, CA071603, CA244468, CA086723, CA146809, CA179822, CA163106, CA139751, CA194118)

SEQ ID No. 271: SCCCRZ1001D02.g
(CA227562, CA113855, CA074155, CA273171, CA244452, CA244374, CA144616, CA220668, CA244135, CA208913, CA197975, CA269055, CA125771, CA281706, CA285773, CA300153, CA154032, CA245267, CA239706, CA146811, CA248711, CA179814, CA194730, CA268428, CA113399, CA242036, CA227897, CA122687, CA082472, CA299324, CA082329, CA292801, CA292314, CA247082, CA260871, CA222252, CA233879, CA130465, CA140466, CA200065, CA073081, CA114463, CA192580, CA296734, CA269090, CA243519, CA078544, CA228562, CA169691, CA177628, CA112868, CA205245, CA269027, CA080412, CA240406, CA146360, CA229125, CA161211, CA230974, CA300322, CA295571, CA121414, CA151083, CA230896, CA232918, CA140354, CA167344, CA221235, CA161123, CA278179, CA092771, CA255868, CA214663, CA250421, CA260387, CA285663, CA089684, CA250336, CA254468, CA293447, CA244735, CA254392, CA292654, CA252918, CA126311, CA278803, CA076762, CA258105, CA136523, CA077192, CA225269, CA077910, CA230058, CA285260, CA229975, CA286249, CA158350, CA233369, CA243156, CA235192, CA092793, CA233280, CA269567, CA080589, CA121250, CA148111, CA117103, CA243125, CA242823, CA297617, CA070960, CA070900, CA182159, CA200781, CA082483, CA202989, CA133586, CA202917, CA166792, CA204111, CA133514, CA191341, CA229632, CA274798, CA112081, CA083506, CA087024, CA283073, CA075468, CA116699, CA117304, CA228310, CA213022, CA147101, CA280824, CA122938, CA269278, CA242644, CA286222, CA189979, CA231030, CA225697, CA216181, CA271428, CA287898, CA216319, CA249895, CA100564, CA255365, CA182292, CA090466, CA259629, CA185920, CA101429, CA130039, CA235211, CA235276, CA130053, CA090380, CA120551,

TABLE XIII-continued

List of Sugarcane Assembled Sequences (SAS) and their SEQ ID Nos.
The EST Genbank accession number is in parentheses. The SEQ ID No. refers to the sequence identifiers in the sequence listing. The listed ESTs assembled to the indicated sequence and should be considered one transcript. Each SAS is differentially expressed between plants with low and high sucrose content or between internode tissues of high and low sucrose content.

CA242902, CA216182, CA242824, CA080452, CA260017, CA081490, CA278950, CA076773, CA182164, CA209332, CA247081, CA194098, CA262165)

SEQ ID No. 272: SCCCRZ1001G10.g
(CA222661, CA243406, CA269416, CA111447, CA122777, CA169118, CA240909, CA124462, CA122846, CA250422, CA244712, CA249447, CA287599, CA070902, CA110739, CA146855, CA256535, CA244795, CA078236, CA067840, CA070962, CA265769, CA156647, CA196108)

SEQ ID No. 273: SCCCRZ1002F06.g
(CA139097, CA266223, CA099736, CA191325, CA138926, CA269667, CA211498, CA224822, CA216862, CA270060, CA301136, CA287834, CA146274, CA096108, CA181984, CA202409, CA084257, CA098085, CA291642, CA240057, CA110222, CA291673, CA217925, CA224622, CA218519, CA240142, CA271896, CA124695, CA232981, CA227222, CA073020, CA209126, CA233047, CA251280, CA072868, CA206681, CA107412, CA298995, CA094500, CA195663, CA211432, CA066295, CA146933, CA220697, CA106447, CA099272, CA076956, CA069454, CA275222, CA145292, CA136184, CA179267, CA148544, CA179893, CA156981, CA114064, CA191309, CA217009, CA069184, CA212599, CA264583, CA229486, CA172986, CA096567, CA067167, CA197128, CA172767, CA253169, CA291720, CA146613, CA180633, CA121860, CA133791, CA199922, CA067244, CA262313, CA078445, CA131567, CA253243, CA074238, CA120588, CA268873, CA238585, CA219714, CA218602, CA267968, CA268534, CA070614, CA145612, CA160457, CA180428, CA268951, CA234136, CA098447, CA193324, CA136123, CA218518, CA184233, CA139019, CA145699, CA260610, CA182962, CA239591, CA099732, CA105807, CA107503, CA138654, CA212476, CA239233, CA252352, CA131278, CA085013, CA220627, CA117443, CA079490, CA238164, CA180322, CA112470, CA142140, CA075732, CA073680, CA068067, CA157313, CA179892, CA233146, CA240845, CA075816, CA068156, CA246078, CA233227, CA279126, CA240923, CA094282, CA069497, CA197493, CA182107, CA166736, CA255275, CA251326, CA198871, CA281656, CA137037, CA070883, CA296203, CA078532, CA207814, CA070947, CA199983, CA282429, CA143090, CA191565, CA189249, CA198125, CA197513, CA203121, CA264333, CA214261, CA196418, CA251452, CA171285, CA156984, CA197506, CA211996, CA100356, CA094466, CA133046, CA270062, CA249901, CA211434, CA225569, CA189822, CA093801, CA100946, CA249815, CA131571, CA220355, CA136957, CA099350, CA064927, CA285088, CA217335, CA139813, CA146454, CA186309, CA217407, CA070684, CA268600, CA199112, CA126792, CA112223, CA265918, CA186374, CA070764, CA099737, CA226973, CA251532, CA142208, CA190634, CA279252, CA174635, CA237846, CA131296, CA224758, CA209005, CA132410, CA187486, CA230626, CA228588, CA080166, CA226226, CA131487, CA209980, CA240058, CA211052, CA230710, CA065368, CA080253, CA165083, CA129937, CA215432, CA280033, CA244591, CA065145, CA064807, CA168165, CA198439, CA218272, CA099578, CA219277, CA218353, CA096715, CA142481, CA142630, CA084917, CA100264, CA213047, CA134830, CA175003, CA121078, CA237503, CA135573, CA244608, CA134915, CA254178, CA135661, CA136819, CA069455, CA157330, CA164187, CA097370, CA067491, CA145272, CA214390, CA098535, CA097056, CA266148)

SEQ ID No. 274: SCCCRZ1003A03.g
(CA259202, CA100500, CA082076, CA122924, CA157918, CA095401, CA187294, CA090612, CA080881, CA112947,

TABLE XIII-continued

List of Sugarcane Assembled Sequences (SAS) and their SEQ ID Nos.
The EST Genbank accession number is in parentheses. The SEQ ID No. refers to the sequence identifiers in the sequence listing. The listed ESTs assembled to the indicated sequence and should be considered one transcript. Each SAS is differentially expressed between plants with low and high sucrose content or between internode tissues of high and low sucrose content.

CA090695, CA130558, CA146966, CA072719, CA296093, CA262625, CA170785, CA145446, CA178555, CA206391, CA250364, CA171994, CA145530, CA147572, CA240600, CA250453, CA095399, CA282848, CA115658, CA095183, CA237700, CA079664, CA233842, CA180299, CA262035)

SEQ ID No. 275: SCCCRZ1C01H06.g
(CA186428, CA147401, CA147396, CA102140, CA131386, CA067698, CA089218, CA174951, CA158992, CA071179, CA196935, CA190380, CA132381, CA232396, CA211475, CA270590, CA124159, CA132671, CA175342, CA300402, CA165879, CA192094, CA110028, CA118616, CA147228, CA140507, CA149523, CA117528, CA130394, CA179398, CA225915, CA187763, CA266799, CA122963, CA217785, CA232794, CA262910, CA292429, CA094522, CA232704, CA127615, CA245193)

SEQ ID No. 276: SCCCRZ2001F06.g
(CA209945, CA125138, CA089034, CA188983, CA140093, CA239385, CA128670, CA123109, CA283553, CA077454, CA149645, CA077376, CA239384, CA110981, CA289986, CA257955, CA274339, CA283333, CA285711, CA248034, CA094452, CA248046, CA119336, CA225096, CA248683, CA225120)

SEQ ID No. 277: SCCCRZ2002C09.g
(CA227904, CA086301, CA178222, CA149034, CA179328, CA164395, CA150695, CA300591, CA266120, CA214033, CA179414, CA101215, CA232117, CA266196, CA230767, CA106384, CA221659, CA077653, CA090620, CA242756, CA203337, CA104567, CA090436, CA214675, CA090702, CA182664, CA299455, CA160657, CA169652, CA115444, CA110086, CA170759, CA104628, CA090335, CA168143, CA252390, CA083307, CA256278, CA081478, CA076382, CA257169, CA205954, CA076469, CA213516, CA257243, CA192918, CA280631, CA151528, CA122818, CA122358, CA088685, CA210655, CA188323, CA253393, CA238275, CA191873, CA135967, CA150598, CA230233, CA091237, CA126923, CA188824, CA280882, CA079326, CA184911, CA173242, CA248830, CA251291, CA246358, CA131973, CA256847, CA075481, CA280627, CA244443, CA241676, CA234839, CA191350, CA132923, CA167430, CA214518, CA289890, CA129459, CA231295, CA234594, CA231360, CA122705, CA171017, CA174592, CA213097, CA203677, CA249784, CA241848, CA154628, CA084636, CA147920, CA084027, CA210274, CA085409, CA073058, CA257603, CA171251, CA235287, CA194012, CA274516, CA189176, CA205967, CA114776, CA249998, CA170208, CA200483, CA079438, CA110598, CA213534, CA081442, CA158958, CA171823, CA201301, CA113037, CA162250, CA091597, CA199925, CA105728, CA149023, CA245774, CA257029, CA294516, CA255995, CA203027, CA251151, CA257109, CA233064, CA089686, CA165671, CA206864, CA197554, CA120723, CA294637, CA195134, CA222415, CA206697, CA089770, CA082495, CA270377, CA096681, CA204010, CA084811, CA225968, CA080123, CA268286, CA177754, CA225888, CA080209, CA280835, CA075666, CA159929, CA223078, CA148574, CA186803, CA139688, CA082737, CA169610, CA071215, CA2S1920, CA071288, CA253042, CA226647, CA067362, CA149705, CA175116, CA183854, CA253113, CA194680, CA229952, CA203951, CA145489, CA183906, CA185885, CA236571, CA183894, CA229664)

SEQ ID No. 278: SCCCRZ2004E04.g
(CA265204, CA171814, CA107719, CA149900, CA193048, CA135977, CA070442)

SEQ ID No. 279: SCCCRZ2C03B03.g
(CA152461, CA091354, CA290267, CA150127, CA098420, CA160838, CA091259, CA210324, CA246275, CA160924, CA099832, CA246979)

SEQ ID No. 280: SCCCRZ2C03B08.g
(CA189326, CA128922, CA152978, CA275251, CA116757, CA206159, CA277339, CA273726, CA288950, CA288339, CA122779, CA274965, CA165128, CA149798, CA281356, CA185850, CA273473, CA083665, CA112203, CA118075, CA119323, CA258675, CA150131, CA260681, CA189332, CA183249, CA282545, CA114816, CA285606, CA284673, CA221505, CA277051, CA113469, CA274816, CA220035)

SEQ ID No. 281: SCCCRZ2C03D11.g
(CA212623, CA218773, CA234879, CA188440, CA150157, CA167123, CA160865, CA152558, CA153910, CA160953, CA292253, CA198906, CA146128, CA152637, CA253272, CA199372, CA081496, CA084800, CA210001, CA165052, CA173701, CA098184, CA198989, CA300667, CA211850, CA160948, CA207047, CA095115, CA136241, CA198430, CA256720, CA251375, CA166995, CA221307, CA110797, CA199377, CA154437, CA256643, CA237901, CA155637, CA237281, CA243431, CA199465, CA113301, CA201599, CA152440, CA186303, CA218694, CA091459, CA075606, CA102523)

SEQ ID No. 282: SCCCRZ2C04A07.g
(CA150208, CA254428, CA264432, CA109026, CA289248, CA212120, CA068378, CA269484, CA290794, CA150592, CA267114, CA108938, CA148663)

SEQ ID No. 283: SCCCRZ3002D03.g
(CA157090, CA166754, CA166468, CA081540, CA166789, CA159915, CA166748, CA158667, CA166054, CA160001, CA159544, CA158534, CA157577, CA163132, CA162955, CA159630, CA162379, CA156383, CA159213, CA156380, CA159296, CA157027, CA155724, CA166592, CA160596, CA157767, CA159130, CA159692, CA160663, CA157459, CA160591, CA162831, CA157771, CA161878, CA159777, CA157345, CA162828, CA160660, CA165592, CA157437, CA156341, CA161644, CA163699, CA166773, CA166732, CA155976, CA166749, CA166465, CA158668, CA166747, CA166717, CA156749, CA157068, CA161600, CA157110, CA155898, CA156928, CA155357, CA155731, CA155982, CA166777, CA165945, CA155803, CA166847, CA158604, CA154735, CA154876, CA157483, CA154704, CA159558, CA162867, CA156720, CA159340, CA157550, CA157322, CA156111, CA159644, CA159429)

SEQ ID No. 284: SCCCST1004A07.g
(CA183604, CA186275, CA243234, CA183683, CA186721, CA100350, CA187378, CA155740, CA175579, CA231947, CA228851, CA155725, CA154689, CA254179, CA172559, CA225984, CA264609, CA242994, CA158084, CA268024, CA173756, CA225902, CA163001, CA185577, CA159081, CA227411, CA139414, CA167973)

SEQ ID No. 285: SCCCST1005H10.g
(CA156092, CA252584, CA251786, CA095869, CA200174, CA229003, CA150731, CA267208, CA111168, CA193424, CA298858, CA284582, CA173902, CA239780, CA210407, CA253368, CA239582)

SEQ ID No. 286: SCCCST1007H11.g
(CA239834, CA294188, CA174066, CA294125, CA289019, CA267191, CA205751, CA247131, CA186999, CA082859, CA248451, CA197532, CA248572, CA248681, CA229903,

TABLE XIII-continued

List of Sugarcane Assembled Sequences (SAS) and their SEQ ID Nos.
The EST Genbank accession number is in parentheses. The SEQ ID No. refers to the sequence identifiers in the sequence listing. The listed ESTs assembled to the indicated sequence and should be considered one transcript. Each SAS is differentially expressed between plants with low and high sucrose content or between internode tissues of high and low sucrose content.

CA291504, CA223912, CA268732, CA229818, CA268664, CA177922, CA299828, CA085026, CA107150, CA270735, CA171072, CA250481, CA198295, CA224502, CA270670, CA111282, CA250414, CA170995, CA248529, CA250649, CA252343, CA115211, CA169576, CA250568, CA169653)

SEQ ID No. 287: SCCCST2004D11.g
(CA276737, CA286409, CA290332, CA180097, CA274366, CA290274, CA276791, CA283900)

SEQ ID No. 288: SCCCST3C01D11.g
(CA192121, CA200064)

SEQ ID No. 289: SCEPCL6019E04.g
(CA278974, CA178777, CA258916, CA210789, CA096932, CA228505, CA292383, CA287368, CA260767, CA258913, CA067293)

SEQ ID No. 290: SCEPLB1043H04.g
(CA112277, CA268601, CA084506, CA123703, CA130941, CA298376, CA100990, CA092352, CA111629, CA259193, CA175844, CA069065, CA236418, CA259195, CA194776, CA197355, CA285641, CA279779, CA274614, CA208294)

SEQ ID No. 291: SCEPRZ1009C10.g
(CA216178, CA089411, CA192966, CA085572, CA147458, CA210405, CA186340, CA080065, CA195484, CA176812, CA086836, CA299623, CA186790, CA174279, CA270325)

SEQ ID No. 292: SCEQLB1065H07.g
(CA113324, CA112585, CA112172)

SEQ ID No. 293: SCEQRT1028H06.g
(CA185370, CA217107, CA185369, CA181686, CA144447, CA259824, CA259055, CA224656, CA132900, CA139337)

SEQ ID No. 294: SCEQRT2091B08.g
(CA177838, CA138900, CA131473)

SEQ ID No. 295: SCEZLR1009F06.g
(CA241512, CA233926, CA203368, CA147610, CA244100, CA143820, CA235700, CA224287, CA076822, CA136422, CA204148, CA132715, CA243514, CA121484, CA149083, CA270033, CA224204, CA235620)

SEQ ID No. 296: SCEZLR1052D02.g
(CA290091, CA101830, CA232662, CA121616, CA136331, CA269565, CA099181, CA274273, CA261699, CA244896, CA264816, CA291831, CA244980, CA242167, CA088365, CA207802, CA164209, CA083724, CA102047, CA144138, CA287479)

SEQ ID No. 297: SCEZLR1052F07.g
(CA074246, CA121654, CA248895, CA133812, CA282557, CA241182, CA114856, CA211933, CA248974, CA276743, CA101051, CA270608, CA276796)

SEQ ID No. 298: SCEZRZ1012A02.g
(CA297050, CA147663, CA157700, CA105038, CA261583, CA271380, CA215641, CA159641, CA069275, CA177800, CA270487)

SEQ ID No. 299: SCJFAM1066B05.g
(CA268766, CA074908, CA268710, CA228447, CA244764, CA274990, CA065083, CA074999)

SEQ ID No. 300: SCJFHR1C03E01.b
(CA105064, CA292248)

SEQ ID No. 301: SCJFLR1013A09.g
(CA235310, CA282013, CA179055, CA283254, CA183161, CA290788, CA164417, CA252946, CA141957, CA096624, CA265391, CA288713, CA274581, CA190135, CA208818, CA279074, CA197553, CA228792, CA167001, CA243611, CA173593, CA132194, CA159403, CA301384, CA172463, CA157575, CA122731, CA163302, CA159490, CA122807, CA290934, CA084459, CA209937, CA276141, CA124943, CA291009, CA101340, CA219373, CA282113, CA301068, CA151204, CA155518, CA261457, CA226015, CA281400, CA277290, CA106860, CA151298, CA131594, CA209070, CA274261, CA230293, CA281699, CA102959, CA242254, CA230377, CA110744, CA297719, CA273517, CA288217, CA283872, CA069932, CA161956, CA152851, CA167994, CA279904, CA072926, CA151486, CA294369, CA285703, CA152126, CA151570, CA123278, CA294297, CA197602, CA169959, CA243645, CA301385, CA264726, CA288442, CA273556, CA139713, CA195766, CA119825, CA145652, CA101345, CA295834, CA278607, CA167657, CA145735, CA164101, CA293116, CA289163, CA284698, CA072930, CA164096, CA274175, CA199249, CA282860, CA253978, CA282859, CA277633, CA274222, CA277807, CA217957, CA066317, CA154676, CA281278, CA131869, CA121746, CA143651, CA283796, CA240378, CA276222, CA180047, CA180206, CA178970, CA280226, CA109795, CA268088)

SEQ ID No. 302: SCJFRT1062G05.g
(CA134706, CA195808, CA245921, CA134625, CA104221)

SEQ ID No. 303: SCJFRZ2009F04.g
(CA151389, CA159376, CA226687, CA146560, CA166765, CA197932, CA159464, CA270358, CA183354)

SEQ ID No. 304: SCJFRZ2010A09.g
(CA151517, CA183884, CA151430)

SEQ 1D No. 305: SCJFRZ2028F11.g
(CA186745, CA152421, CA186827, CA211953, CA191943, CA198909, CA224105, CA200632, CA255362, CA066398, CA131076, CA201119, CA299210, CA299133, CA200718, CA131498, CA157938, CA205075, CA160778, CA064989, CA277477, CA281350)

SEQ ID No. 306: SCJFRZ2032C08.g
(CA117340, CA295374, CA295303, CA152817)

SEQ ID No. 307: SCJFRZ2032G01.g
(CA133254, CA248557, CA175553, CA290388, CA170294, CA152856, CA171924, CA205645, CA233534, CA221515, CA081654, CA171952, CA065512, CA081995, CA166558, CA065587, CA078958, CA211764, CA237388, CA258073)

SEQ ID No. 308: SCJFST1009G05.g
(CA296907, CA174288, CA269643, CA174211, CA193249)

SEQ ID No. 309: SCJLHR1028C12.g
(CA106176, CA106117, CA108309, CA107078)

SEQ ID No. 310: SCJLLR1054C09.g
(CA207848, CA168087, CA168395, CA212085, CA167523, CA091873, CA122611, CA155006, CA181705, CA134394, CA225549, CA210454, CA254817, CA110775, CA178602, CA294600, CA247901, CA176250, CA191684, CA069266, CA300512, CA165622, CA155090, CA067961, CA171908, CA209040, CA173982, CA094706, CA240234, CA103017, CA122429, CA150920, CA112960, CA162575, CA122515, CA160567, CA113924, CA066919, CA160642, CA221530, CA208709, CA071863, CA214558, CA220510, CA123419,

TABLE XIII-continued

List of Sugarcane Assembled Sequences (SAS) and their SEQ ID Nos.
The EST Genbank accession number is in parentheses. The SEQ ID No. refers to the sequence identifiers in the sequence listing. The listed ESTs assembled to the indicated sequence and should be considered one transcript. Each SAS is differentially expressed between plants with low and high sucrose content or between internode tissues of high and low sucrose content.

CA244626, CA231363, CA228474, CA111123, CA134073, CA146492, CA244685, CA219982, CA073891, CA174808, CA221075, CA262113, CA114521, CA162927, CA115467, CA161791, CA168280, CA152952, CA091868, CA233706, CA164651, CA204996, CA129415, CA172853, CA166113, CA107134, CA254985, CA159872, CA159959, CA088872, CA173464)

SEQ ID No. 311: SCJLLR1108H07.g
(CA076625, CA161661, CA086613, CA161602, CA165554, CA245933, CA085287, CA123416, CA161598, CA175504, CA232025, CA166769, CA102997, CA076538, CA107411, CA155427, CA084502, CA106431, CA154641, CA106546, CA157227, CA154884, CA079948, CA179653, CA211436, CA121982, CA162963, CA258991, CA160716, CA243419, CA079250, CA072412, CA086508)

SEQ ID No. 312: SCJLRZ1023H04.g
(CA265135, CA190996, CA292308, CA268081, CA256348, CA207478, CA081712, CA292758, CA256420, CA167022, CA291705, CA091971, CA179799, CA140075, CA266752, CA291699, CA258363, CA113856, CA149162, CA262595, CA140368, CA246964, CA235343, CA155907, CA140145, CA279058, CA274307, CA165644, CA278889, CA205578, CA091372, CA181941, CA166813, CA299890, CA177590, CA072486, CA156132, CA248336)

SEQ ID No. 313: SCJLRZ1026F03.g
(CA149469, CA205387, CA289827, CA184015, CA247348, CA282029, CA187706, CA205445)

SEQ ID No. 314: SCMCCL6055H06.g
(CA183309, CA272155, CA071587, CA154790, CA236184, CA111608, CA231710, CA288208, CA098251, CA238333, CA187031, CA071503, CA293423)

SEQ ID No. 315: SCMCFL5005A02.g
(CA236668, CA293232, CA251482)

SEQ ID No. 316: SCQGLR1019A10.g
(CA158123, CA074136, CA078695, CA202125, CA242927, CA291653, CA258225, CA223738, CA242859, CA124066, CA230103, CA120900, CA154098, CA255904, CA223648, CA129680, CA230031, CA082294, CA246357, CA262363, CA265415, CA118654, CA213833, CA125970, CA127771, CA246827, CA247296, CA087908, CA171645, CA102269, CA272756, CA137758, CA088231, CA148006, CA122701, CA187495, CA239190, CA230034, CA228513, CA074865, CA285487, CA147299, CA125885, CA236307, CA076601, CA116390, CA074785)

SEQ ID No. 317: SCQGLR1085G10.g
(CA246799, CA299090, CA247266, CA285442, CA124279, CA092800, CA073766, CA200888, CA282968)

SEQ ID No. 318: SCQGLR2032G10.g
(CA080092, CA073014, CA139013, CA225342, CA159885, CA165867, CA299929, CA118209, CA159972, CA108533, CA108413, CA106301, CA086875, CA086531, CA129084)

SEQ ID No. 319: SCQGRZ3011D06.g
(CA161694, CA227205, CA245780, CA216248)

SEQ ID No. 320: SCQGSB1140F12.g
(CA213355, CA173336)

SEQ ID No. 321: SCQGST1034G10.g
(CA178801, CA186336, CA179790, CA176353, CA177570,

CA236876, CA131335, CA214405, CA236124, CA186273, CA284135, CA216656, CA300978)

SEQ ID No. 322: SCQSHR1023F08.g
(CA282568, CA106894, CA104925, CA211813)

SEQ ID No. 323: SCRFFL5034G07.g
(CA292908, CA237588, CA237589)

SEQ ID No. 324: SCRLAD1100E08.g
(CA218592, CA211503, CA218509)

SEQ ID No. 325: SCRLAM1010D08.g
(CA212204, CA199909, CA248341, CA242304, CA256227, CA172929, CA220898, CA078708, CA247486, CA280865)

SEQ ID No. 326: SCRLFL1008C11.g
(CA228213, CA201789, CA206320)

SEQ ID No. 327: SCRLFL1012B10.g
(CA200156, CA199546)

SEQ ID No. 328: SCRLFL3007C04.g
(CA226398)

SEQ ID No. 329: SCRLLR1111D02.g
(CA293691, CA293635, CA125789)

SEQ ID No. 330: SCRLSD1012E03.g
(CA274071, CA285380)

SEQ ID No. 331: SCRLST3166F11.g
(CA182238, CA171790, CA184723)

SEQ ID No. 332: SCRUAD1063C06.g
(CA068638, CA265707, CA068550, CA109839)

SEQ ID No. 333: SCRUAD1133D10.b
(CA217707, CA260899, CA295151)

SEQ ID No. 334: SCRURT2010A10.g
(CA144026, CA210038, CA197343, CA252900, CA067500)

SEQ ID No. 335: SCSBAM1084F08.g
(CA198503, CA079138, CA079137)

SEQ ID No. 336: SCSBHR1052C05.g
(CA196243, CA215089, CA164400, CA195955, CA108007, CA139925, CA215090, CA224796, CA098473, CA209222, CA197036, CA209253)

SEQ ID No. 337: SCSBHR1056H08.g
(CA105333, CA108213)

SEQ ID No. 338: SCSBLB1035F03.g
(CA264024, CA104540, CA115550, CA212924)

SEQ ID No. 339: SCSBSD2058D04.g
(CA287176, CA297226, CA287175)

SEQ ID No. 340: SCSFAD1124E07.g
(CA066760, CA217172, CA066828, CA217514)

SEQ ID No. 341: SCSFHR1043G09.g
(CA108353, CA218662, CA212351)

SEQ ID No. 342: SCSGFL5C08F04.g
(CA246146, CA236946, CA246999)

TABLE XIII-continued

List of Sugarcane Assembled Sequences (SAS) and
their SEQ ID Nos.
The EST Genbank accession number is in parentheses. The SEQ ID No. refers to the sequence
identifiers in the sequence listing. The listed
ESTs assembled to the indicated sequence and
should be considered one transcript. Each SAS is
differentially expressed between plants with low
and high sucrose content or between internode
tissues of high and low sucrose content.

SEQ ID No. 343: SCSGLR1045E07.g
(CA168455, CA126284, CA177719, CA172031)

SEQ ID No. 344: SCSGRT2066D05.g
(CA070717, CA175523, CA145621, CA187735)

SEQ ID No. 345: SCUTAM2088G02.g
(CA091716, CA090231, CA091719)

SEQ ID No. 346: SCUTFL3073E12.g
(CA257224, CA241247, CA292613)

SEQ ID No. 347: SCUTLR1037F04.g
(CA170823, CA177197, CA279404, CA222805, CA121507,
CA289444, CA282074, CA207370, CA115893, CA105265,
CA226291, CA170108, CA263098, CA132119, CA107841,
CA085728, CA126622, CA227826, CA227505, CA260163,
CA262467, CA193720, CA219325, CA177230, CA103517,
CA170340, CA170414, CA105596, CA112997, CA228100,
CA234662, CA258511, CA097304, CA120418)

SEQ ID No. 348: SCUTLR1037F12.g
(CA156611, CA293535, CA249045, CA087183, CA189165,
CA086047, CA290121, CA081883, CA214139, CA229204,
CA113764, CA213924, CA260485, CA126357, CA230132,
CA221003, CA187849, CA273962, CA225939, CA102197,
CA283956, CA183828, CA218025, CA195893, CA085608,
CA263834, CA290919, CA183344, CA241008, CA104921,
CA066522, CA290997, CA172858, CA095919, CA247671,
CA186981, CA133280, CA245107, CA257283, CA115814,
CA258330, CA212915, CA119073, CA194926, CA239944,
CA104400, CA113297, CA104485, CA087184, CA069789,
CA179218, CA231826, CA231159, CA086089, CA076690,
CA246370, CA254495, CA091273, CA100677, CA106434,
CA230786, CA253134, CA257292, CA231505, CA225180,
CA241459, CA198266, CA115318, CA161747, CA103920,
CA152307, CA133281, CA086095, CA231031, CA187270,
CA242618, CA144012, CA111808, CA238509, CA253529,
CA089266, CA157653, CA228713, CA106021, CA117820,
CA126627, CA104401, CA211834, CA182929, CA104486)

SEQ ID No. 349: SCUTLR1058C02.g
(CA262461, CA168036, CA230840, CA293241, CA281414,
CA281585, CA106941, CA142008, CA151458, CA092310,
CA270530, CA270458, CA225598, CA151543, CA202726,
CA128347, CA241827, CA282746, CA128419, CA119915,
CA204605, CA215500, CA170573, CA164411, CA134253,
CA142288, CA176323, CA195642, CA255302, CA158993,
CA283479, CA283473, CA126682, CA118166, CA213449,
CA157587, CA207851)

SEQ ID No. 350: SCUTLR2008E01.g
(CA123373, CA129763, CA128815)

SEQ ID No. 351: SCUTRZ2024G05.g
(CA234849, CA204407, CA105515, CA224224, CA109551,
CA143843, CA279720, CA161103, CA224302, CA299491,
CA122794, CA179195, CA153592, CA105749, CA164517)

SEQ ID No. 352: SCUTST3086B02.g
(CA213057, CA224653)

SEQ ID No. 353: SCUTST3129E01.g
(CA172415, CA213379, CA187638)

SEQ ID No. 354: SCVPCL6041F12.g
(CA082429, CA161720, CA139420, CA272127, CA238764,
CA215035, CA194711, CA209687, CA171991, CA172016,
CA165652, CA156463)

SEQ ID No. 355: SCVPCL6042B07.g
(CA169577, CA081626, CA106612, CA099887, CA081969)

SEQ ID No. 356: SCVPLR1049C09.g
(CA295256, CA300966, CA278033, CA090854, CA282609,
CA121190, CA216481, CA267073, CA111152, CA126945,
CA280319, CA278841, CA262278, CA287391, CA296360,
CA296426, CA248739, CA287386, CA259530, CA296500,
CA266143, CA216477, CA150885, CA248822, CA096454,
CA099843, CA252370, CA087591, CA266218, CA071726,
CA081002, CA087680, CA240033, CA219541, CA202897,
CA077216, CA219614, CA066229, CA281069)

SEQ ID No. 357: SCVPLR1049E12.g
(CA124363, CA107272, CA132969, CA091837, CA126955,
CA122520, CA182701, CA167289)

SEQ ID No. 358: SCVPLR2005H03.g
(CA107547, CA139171, CA074786, CA265130, CA268083,
CA243200, CA074866, CA134745, CA100667, CA131059,
CA264817, CA254269, CA268118, CA264761, CA121869,
CA201866, CA220819, CA156636, CA097099, CA289841,
CA222964, CA116567, CA091798, CA219374, CA138613,
CA221255, CA132550, CA289940, CA251888, CA205653,
CA100956, CA293549, CA243537, CA136973, CA120370,
CA158202, CA228366, CA260312)

SEQ ID No. 359: SCVPLR2012B07.g
(CA130160, CA266175, CA077480, CA072583, CA084569,
CA194404, CA278936, CA240283, CA201232, CA288279,
CA077401, CA066454, CA180797, CA244848, CA266247,
CA130150, CA137685, CA233499)

SEQ ID No. 360: SCVPLR2019B03.g
(CA087275, CA087192, CA125068, CA101699, CA222267,
CA259282, CA248553, CA223061, CA172804, CA200147,
CA130990, CA225681, CA231261, CA223347, CA255228,
CA273849, CA254244, CA156394, CA163312, CA117607,
CA078324, CA072741, CA248475, CA212519, CA124666,
CA126419, CA268138, CA105146, CA299030, CA177516,
CA222789, CA105222, CA253702, CA202841, CA077031,
CA077074, CA295407, CA118765, CA265852, CA289740,
CA156183, CA197419, CA292775, CA207673, CA225709,
CA153732, CA169731, CA102976, CA254955, CA228712,
CA067636, CA264512, CA130214, CA130204, CA106807,
CA207166, CA198764, CA216476, CA197293, CA103316,
CA202300, CA077735, CA211185, CA067184, CA159570,
CA258272, CA067264, CA159656, CA200260, CA117368,
CA183438)

SEQ ID No. 361: SCVPLR2027A05.g
(CA235611, CA214709, CA235691, CA229065, CA216821,
CA251974, CA085301, CA101012, CA271269, CA197839,
CA223162, CA118164, CA086683, CA223250, CA221375,
CA188324, CA130277, CA130307, CA291410, CA227333,
CA279299, CA289704, CA167019, CA207029, CA206493,
CA270288, CA176609, CA255410, CA166845, CA070734,
CA073573, CA070813, CA112278, CA295884)

SEQ ID No. 362: SCVPRZ2038F04.g
(CA278038, CA154019, CA185583)

SEQ ID No. 363: SCVPRZ3025A12.g
(CA070455, CA292147, CA245381, CA166400, CA204294,
CA242140)

TABLE XIII-continued

List of Sugarcane Assembled Sequences (SAS) and their SEQ ID Nos.
The EST Genbank accession number is in parentheses. The SEQ ID No. refers to the sequence identifiers in the sequence listing. The listed ESTs assembled to the indicated sequence and should be considered one transcript. Each SAS is differentially expressed between plants with low and high sucrose content or between internode tissues of high and low sucrose content.

SEQ ID No. 364: SCVPRZ3029G09.g
(CA239171, CA273853, CA166786, CA203209)

SEQ ID No. 365: SCMCST1053A06.g
(CA110730, CA157435, CA164231, CA176670, CA079493, CA088347)

SEQ ID No. 366: SCCCLB1C06H02.g
(CA189458, CA167345, CA115196, CA207187, CA252023)

SEQ ID No. 367: SCJLRT1023G09.g
(CA077219, CA072472, CA136050, CA078881, CA266374, CA224918, CA162043, CA091967, CA074650)

SEQ ID No. 368: SCCCST1004C05.g
(CA098064, CA072037, CA194838, CA098063, CA173775, CA074361, CA079156, CA098059, CA084783)

SEQ ID No. 369: SCCCLB1002D12.g
(CA092064, CA238036, CA222592, CA227487, CA110870, CA207790)

SEQ ID No. 370: SCSGHR1070F12.g
(CA076267, CA109334)

SEQ ID No. 371: SCEQLR1092H10.g
(CA279813, CA186407, CA212604, CA279552, CA186484, CA135161, CA069193, CA103839, CA121281, CA153767, CA285432, CA182006, CA131451, CA285178, CA078267, CA078257, CA205885, CA136733, CA205884, CA097155, CA264106, CA279798, CA163611, CA091480, CA091191, CA187913, CA261976, CA277443, CA204843, CA273593, CA287502, CA287253, CA085398, CA222671)

SEQ ID No. 372: SCJFST1011B06.g
(CA239247, CA174473, CA262684, CA211312, CA218557)

SEQ ID No. 373: SCEQRT2030G04.g
(CA138771, CA145363, CA291384)

TABLE XIV

SNF-related like kinase genes and regulatory subunits differentially expressed between high brix and low brix varieties. Four individuals were selected from SP83-2847 (V1), four from SP94-3116 (V3), four from SP91-1049 (V2) and four from SP89-1115 (V4). RNA samples from the indicated tissues and collected months were used to generate probes for cDNA microarray hybridizations. The last four columns indicate the average ratios and the fold induction when the high and low brix samples were compared against an equimolar mixture of RNAs from the same varieties collected in march (when the cell is empty differential expression was not detected on the sample) The average brix measures are shown in FIG. 6.

| | | | | | | | High Brix | | Low Brix | |
|---|---|---|---|---|---|---|---|---|---|---|
| | Experiment | SAS | Category | sub category 1 | sub category 2 | sub category 3 | V2 | V4 | V1 | V3 |
| Leaf | March | SCCCLB1002D12.g | Protein kinases | SNF-like kinases | caneCIPK-24 | SNF-like/CBL-interacting Protein Kinase | | | 3.2 | |
| | | SCSGHR1070F12.g | Protein kinases | SNF-like kinases | caneCIPK-29 | SNF-like/CBL-interacting Protein Kinase | | | 2.7 | |
| | | SCEQLR1092H10.g | Carbohydrate met | SIP homologue (AKIN gamma) | . | . | | | 2.5 | |
| | | SCJFST1011B06.g | Carbohydrate met | Similar to AKINbetagamma | . | . | 6.7 | | 4.6 | |
| | May | SCJFST1011B06.g | Carbohydrate met | Similar to AKINbetagamma | . | . | 10.5 | 3.7 | 4.7 | 6.2 |
| | September | SCEQRT2030G04.g | Protein kinases | SNF-like kinases | caneCIPK-26 | SNF-like-CBL-interacting Protein Kinase | | | 3.2 | |
| | | SCEQLR1092H10.g | Carbohydrate met | SIP homologue (AKIN gamma) | . | . | 2.7 | | | |
| | | SCJFST1011B06.g | Carbohydrate met | Similar to AKINbetagamma | . | . | −4.1 | | 1.5 | |
| Internode 1 | March | SCJFST1011B06.g | Carbohydrate met | Similar to AKINbetagamma | . | . | 1.5 | 1.9 | 3.0 | |
| | May | SCJFST1011B06.g | Carbohydrate met | Similar to AKINbetagamma | . | . | | | 2.4 | |
| | July | SCJFST1011B06.g | Carbohydrate met | Similar to AKINbetagamma | . | . | 3.1 | 2.4 | 3.6 | 2.7 |
| | September | SCJFST1011B06.g | Carbohydrate met | Similar to AKINbetagamma | . | . | −3.0 | −1.8 | | |

TABLE XV

Genes differentially expressed between internode 9 (mature, rich in sugar) and internode 1 (immature, poor in sugar) from a pool of seven high brix plants. The individuals were selected from an F1 progeny of a cross between two commercial varieties, SP80-180 and SP80-4966. RNA samples from internode 9 (mature, rich in sugar) and internode 1 (immature, poor in sugar) were collected in March from the seven highest brix individuals and used to generate probes for cDNA microarray hybridizations. The column High indicates the average ratios (fold induction) of genes more expressed in internode 9 than in internode 1. The column Low indicates the average ratios (fold induction) of genes more expressed in internode 1 than in internode 9. The average brix in the highest sugar internodes was 18.47.

| SAS | Category | Description of homologue | High | Low |
| --- | --- | --- | --- | --- |
| SCCCLR1001E04.g | Carbohydrate Metabolism | Photosynthesis RUBISCO - small subunit | | 5.17088 |
| SCSGFL5C08F04.g | Unknown protein | | | 14.5502 |
| SCCCLR1024E11.g | Stress | Superoxide dismutases Cu/Zn | | 3.52866 |
| SCCCLR1068G11.g | DNA metabolism | Histone H2B | | 3.17131 |
| SCEZRZ1012A02.g | Stress | Cytochrome P450 CYP9 | | 5.68635 |
| SCSBAD1084C01.g | Others | Tubulin alpha-1 chain | | 2.37024 |
| SCCCLR2002D04.g | DNA metabolism | Histone H4 | | 3.09739 |
| SCJFRZ2032G01.g | Protein kinases | SNF-like kinases caneSnRK1-2 | | 1.69948 |
| SCCCLR2002F08.g | Hormone related | Auxin auxin repressed | | 2.0465 |
| SCVPFL3045B09.g | Stress | Metalothionein | | 3.46187 |
| SCJLHR1028C12.g | Stress | Infected libraries Histone H4 | | 4.71202 |
| SCVPLR2019B03.g | Pathogenicity | Polygalacturonase inhibitor | | 4.46784 |
| SCJLRZ1023H04.g | Protein kinases | SNF-like kinases caneCIPK-9 | | 4.32708 |
| SCCCLR2C03D05.g | Stress | Superoxide dismutases Cu/Zn | | 4.75184 |
| SCCCRT2001H11.g | Small GTPases | Arf | | 1.9028 |
| SCCCRZ1001D02.g | Adapters | 14-3-3 proteins | | 1.90957 |
| SCCCRZ2C03D11.g | Transcription | Scarecrow | | 2.8597 |
| SCRLLR1111D02.g | No matches (non-coding) | | | 3.55119 |
| SCCCRZ1002F06.g | Stress | Drought and cold response Enolase | | 2.15317 |
| SCBFAD1046D01.g | Transcription | HLH (helix-loop-helix) | | 3.05338 |
| SCRLST3166F11.g | No matches (non-coding) | | | 1.7087 |
| SCCCRZ2002C09.g | Others | Alpha tubulin | | 2.30795 |
| SCCCCL3120C09.g | Receptors | Receptor Ser/Thr kinase cane RLK with LysM-1 | | 2.72539 |
| SCEQRT1025D06.g | Adapters | 14-3-3 proteins | | 1.76605 |
| SCSGLR1045E07.g | Receptors | Receptor Ser/Thr kinase caneLTK1-15 (leucine-rich transmembrane kinase) | | 3.27161 |
| SCCCRZ1001A09.g | Unknown protein | | | 3.47497 |
| SCUTFL3073E12.g | Unknown protein | | | 3.88751 |
| SCJFLR1074E09.g | Stress | Drought and cold response Low temperature induced (LT1) | | 2.73407 |
| SCUTST3129E01.g | Unknown protein | | | 3.16936 |
| SCVPLR2005H03.g | Transcription | Aux/IAA | | 2.96052 |
| SCCCLR2002G09.g | DNA metabolism | Histone H4 | | 5.40529 |
| SCVPRT2074D04.g | Unknown protein | | | 10.9716 |
| SCMCST1053A06.g | Receptors | Receptor Ser/Thr kinase canePERK1-3 | | 2.55721 |
| SCCCRZ1001G10.g | Transcription | Aux/IAA | | 3.20251 |
| SCBFLR1039B05.g | Carbohydrate Metabolism | Xyloglucan endotransglycosylase | | 7.23097 |
| SCCCRZ1C01H06.g | Calcium | Calmodulin-binding proteins Apyrase | | 5.42483 |
| SCSBSD2029F05.g | Unknown protein | | 29.3706 | |
| SCSFHR1043G09.g | Stress | Infected libraries S-adenosylmethionine synthase | 2.57568 | |
| SCEZHR1087F06.g | Stress | Cytochrome P450 CYP84 | 3.71447 | |
| SCJFLR1013A09.g | Stress | Drought and cold response Cysteine proteinase RD19A precursor | 2.34682 | |
| SCCCAD1004H02.g | Stress | Catalase | 4.81462 | |
| SCSBHR1056H08.g | Receptors | EIN2 (ethylene) | 2.2665 | |

TABLE XVI

Genes differentially expressed between Internode 9 (mature, rich in sugar) and internode 1 (immature poor in sugar) from a pool of seven high brix plants. The individuals were selected from an F1 progeny of a cross between two commercial varieties, SP80-180 and SP80-4966. RNA samples from internode 9 (mature, rich in sugar) and internode 1 (immature, poor in sugar) were collected in July from the seven highest brix individuals and used to generate probes for cDNA microarray hybridizations. The column High indicates the average ratios (fold induction) of genes more expressed in internode 9 than in internode 1. The column Low indicates the average ratios (fold induction) of genes more expressed in internode 1 than in internode 9. The average brix in the highest sugar internodes was 22.63.

| SAS | Category | Description of homologue | High | Low |
| --- | --- | --- | --- | --- |
| SCCCHR1004D03.g | Receptors | Receptor Ser/Thr kinase caneRLK-CII1 | | 2.886 |
| SCEQRT2091B08.g | Pathogenicity | R-genes NBS-LRR | | 6.61364 |
| SCCCRZ1001D02.g | Adapters | 14-3-3 proteins | | 4.07912 |
| SCACLR2022H05.g | Lipid metabolism | Acyl carrier protein-like | | 2.62875 |

TABLE XVI-continued

Genes differentially expressed between Internode 9 (mature, rich in sugar) and internode 1 (immature poor in sugar) from a pool of seven high brix plants. The individuals were selected from an F1 progeny of a cross between two commercial varieties, SP80-180 and SP80-4966. RNA samples from internode 9 (mature, rich in sugar) and internode 1 (immature, poor in sugar) were collected in July from the seven highest brix individuals and used to generate probes for cDNA microarray hybridizations. The column High indicates the average ratios (fold induction) of genes more expressed in internode 9 than in internode 1. The column Low indicates the average ratios (fold induction) of genes more expressed in internode 1 than in internode 9. The average brix in the highest sugar internodes was 22.63.

| SAS | Category | Description of homologue | High | Low |
|---|---|---|---|---|
| SCCCLR1022D05.g | Adapters | 14-3-3 proteins | | 2.98657 |
| SCCCHR1004H09.g | Others | Putative cholinephosphate cytidylyltransferase | | 1.92571 |
| SCAGLR1021G10.g | Transcription | Homeobox knotted homeobox | | 2.32589 |
| SCCCRZ1C01H06.g | Calcium | Calmodulin-binding proteins Apyrase | | 7.92529 |
| SCAGLR2026G12.g | No matches | | | 3.39302 |
| SCCCRZ2002C09.g | Others | Alpha tubulin | | 4.67588 |
| SCEZRZ1012A02.g | Stress | Cytochrome P450 CYP9 | | 4.61871 |
| SCUTST3129E01.g | Unknown protein | | | 1.91148 |
| SCRFLR2037F09.g | Calcium | Calreticulin | | 2.02563 |
| SCCCLR1072H06.g | Receptors | Receptor Ser/Thr kinase caneRLK-CIII5 | | 2.00064 |
| SCCCRZ2C03B08.g | Unknown protein | | | 2.91431 |
| SCRLAM1010D08.g | Transcription | Homeobox knotted homeobox | | 2.79028 |
| SCRLFL3007C04.g | Receptors | Receptor Ser/Thr kinase caneRLK-D5 | | 4.32835 |
| SCSBAD1084C01.g | Others | Tubulin alpha-1 chain | | 4.77431 |
| SCCCLR2C02A05.g | Development | Expansin | | 2.51264 |
| SCBFST3136A06.g | No matches | | | 1.64093 |
| SCCCST1005H10.g | Stress | Drought and cold response erd3-like | | 2.28191 |
| SCVPRZ3025A12.g | Protein kinases | RLCK canePBS1-6 | | 3.88743 |
| SCBGFL4053F12.g | Receptors | Receptor Ser/Thr kinase caneRLK-DV2 | | 3.57578 |
| SCCCST1007H11.g | Small GTPases | Rab | | 2.33447 |
| SCJFRZ2009F04.g | Transcription | Aux/IAA | | 2.29158 |
| SCJLLR1054C09.g | Transcription | Aux/IAA | | 2.65943 |
| SCJFST1009G05.g | Protein kinases | Putative RLCK caneRLCK-A3 | | 2.13741 |
| SCBFLR1039B05.g | Carbohydrate Metabolism | Xyloglucan endotransglycosylase | | 11.4992 |
| SCSBHR1052C05.g | Inositol | Others Phospholipase C | | 1.7622 |
| SCCCLR2C03D05.g | Stress | Superoxide dismutases Cu/Zn | | 3.71548 |
| SCCCCL4004C06.g | Unknown protein | | | 5.53096 |
| SCCCCL3120C09.g | Receptors | Receptor Ser/Thr kinase cane RLK with LysM-1 | | 4.75777 |
| SCCCRT1001E12.g | Small GTPases | Rab | | 3.51448 |
| SCEQRT1028H06.g | Hormone biosynthesis | Auxin Nitrilase | | 2.22559 |
| SCCCRT2001H11.g | Small GTPases | Arf | | 3.62744 |
| SCSGLR1045E07.g | Receptors | Receptor Ser/Thr kinase caneLTK1-15 (leucine-rich transmembrane kinase) | | 4.26249 |
| SCCCRZ1001C12.g | Stress | Cytochrome P450 CYP51 | | 1.63378 |
| SCCCLB1023E12.g | Receptors | Receptor Ser/Thr kinase caneRLK-DXIV1 (with LRR) | | 1.75209 |
| SCUTAM2115C12.g | Unknown protein | | | 4.03376 |
| SCCCRZ1001G10.g | Transcription | Aux/IAA | | 4.81226 |
| SCCCLR1024E11.g | Stress | Superoxide dismutases Cu/Zn | | 2.64644 |
| SCCCLR1072E03.g | Receptors | Receptor Ser/Thr kinase caneRLK-AX3 | | 3.18447 |
| SCCCRZ2C04A07.g | Stress | Cytochrome P450 CYP71E | | 7.26294 |
| SCVPRT2074D04.g | Unknown protein | | | 17.1483 |
| SCCCCL5002B10.g | Protein kinases | Undefined-unclassified caneUPK-87 | | 2.6046 |
| SCRURT2010A10.g | Transcription | Putative transcription factor (myb) | | 3.35245 |
| SCRUSB1062E12.g | Lipid metabolism | Putative triacylglycerol lipase | | 2.38531 |
| SCBGLR1096C08.g | Protein kinases | Cell cycle-related caneCDK-18 | | 3.2602 |
| SCUTST3086B02.g | Transcription | AP2/EREBP Tiny | | 2.12353 |
| SCSBLB1035F03.g | Receptors | Receptor Ser/Thr kinase-unclassified caneURLK-119 (with LRR) | | 5.9116 |
| SCEPRZ1009C10.g | Protein kinases | SNF-like kinases cane osmotic stress-activated protein kinase-1 | | 3.54108 |
| SCJLRZ1026F03.g | Protein kinases | Putative RLCK caneRLCK-AII2 | | 2.347 |
| SCEQRT1031D02.g | Adapters | 14-3-3 proteins | | 3.968 |
| SCSGFL5C08F04.g | Unknown protein | | | 16.0517 |
| SCUTRZ2024G05.g | Transport | Putative vesicle transport v-SNARE protein | | 1.9247 |
| SCQGLR1085G10.g | Transcription | MADS | 1.7433 | |
| SCRUAD1063C06.g | Pathogenicity | Polygalacturonase-inhibiting | 1.66301 | |
| SCEPCL6019E04.g | Carbohydrate metabolism | Malic enzyme | 1.89688 | |
| SCCCAD1004H02.g | Stress | Catalases | 2.66819 | |
| SCRLST3166F11.g | No matches (non-coding) | | 1.95495 | |
| SCSFAD1124E07.g | Transcription | Myb | 4.31601 | |
| SCCCCL5004D02.g | No matches | | 1.51467 | |
| SCQGSB1140F12.g | Pathogenicity | R-genes NBS-LRR | 2.44294 | |
| SCCCRZ1003A03.g | Calcium | Calmodulin-binding proteins HSP7s (heat shock) | 1.78283 | |

TABLE XVII

Genes differentially expressed between Internode 9 (mature rich in sugar) Internode 1 (immature, poor in sugar) from a pool of seven low brix plants. The individuals were selected from an F1 progeny of a cross between two commercial varieties, SP80-180 and SP80-4966. RNA samples from internode 9 (mature, rich in sugar) and internode 1 (immature, poor in sugar) were collected in March from the seven lowest brix individuals and used to generate probes for cDNA microarray hybridizations. The column High indicates the average ratios (fold induction) of genes more expressed in internode 9 than in internode 1. The column Low indicates the average ratios (fold induction) of genes more expressed in internode 1 than in internode 9. The average brix in the highest sugar internodes was 13.66.

| SAS | Category | Description of homologue | High | Low |
|---|---|---|---|---|
| SCUTFL3073E12.g | Unknown protein | | | 2.0326 |
| SCBGLR1096E06.g | Nucleotide metabolism | Putative inosine monophosphate dehydrogen | | 2.58395 |
| SCBFLR1039B05.g | Carbohydrate Metabolis | Xyloglucan endotransglycosylase | | 5.33996 |
| SCSBAD1084C01.g | Others | Tubulin alpha-1 chain | | 2.90392 |
| SCUTLR1037F12.g | Protein metabolism | 60S Ribosomal protein L5 | | 2.60981 |
| SCCCST1004C05.g | Protein kinases | Others caneIre1-1 (Similar to ER-located transmembranereceptor protein kinase/ribo-nuclease) | | 2.12312 |
| SCCCLB1001D03.g | Protein Phosphatases | Serine/Threonine - PPP Family PP2A/Catalytic Subunit | | 1.55983 |
| SCCCCL5002B10.g | Protein kinases | Undefined-unclassified caneUPK-87 | | 1.91338 |
| SCRLFL1012B10.g | Protein kinases | Cell cycle-related caneCDK-6 | | 1.8469 |
| SCJFRZ2010A09.g | Ubiquitination | E1 | | 2.19142 |
| SCVPAM1055A12.g | Protein kinases | Casein kinases caneCKI-11 | | 2.3001 |
| SCRLSD1012E03.g | Ubiquitination | Ubiquitin | | 1.97292 |
| SCCCLR2002D04.g | DNA metabolism | Histone H4 | | 2.17368 |
| SCJFRZ2032G01.g | Protein kinases | SNF-like kinases caneSnRK1-2 | | 2.89539 |
| SCSBHR1050B11.g | Development | Putative senescence-associated protein | | 7.68477 |
| SCCCLR2002G09.g | DNA metabolism | Histone H4 | | 4.16496 |
| SCVPCL6042B07.g | Protein kinases | Others cane cyclin G-associated kinase-like protein-1 | | 1.98527 |
| SCJLLR1108H07.g | Calcium | Calmodulin-binding proteins ACA | | 1.94396 |
| SCVPFL3045B09.g | Stress | Metalothionein | | 2.75676 |
| SCCCLR2C03D05.g | Stress | Superoxide dismutases Cu/Zn | | 2.09879 |
| SCJLRT1023G09.g | Protein kinases | SNF-like kinases caneCIPK-19 | | 1.95006 |
| SCVPLR1049C09.g | Calcium | Calmodulin-binding proteins ATPase | | 2.32277 |
| SCCCRT1001E12.g | Small GTPases | Rab | | 1.78307 |
| SCVPLR2019B03.g | Pathogenicity | Polygalacturonase inhibitor | | 4.69134 |
| SCVPRZ3029G09.g | Receptors | Receptor Ser/Thr kinase caneLTK1-16 (leucine-rich transmembrane kinase) | | 1.72477 |
| SCCCLB1023E12.g | Receptors | Receptor Ser/Thr kinase caneRLK-DXIV1 (with LRR) | | 1.94444 |
| SCEZLR1052D02.g | Unknown protein | | | 1.9867 |
| SCCCRZ1001G10.g | Transcription | Aux/IAA | | 2.01005 |
| SCEZLR1052F07.g | Protein Phosphatases | Serine/Threonine - PPP Family PP2A/Subunit A | | 1.69977 |
| SCCCRZ1004H12.g | Transcription | EIL (ethylene-insensitive3-like) | | 2.6871 |
| SCACLR1130H08.g | Transcription | Zinc finger proteins C2C2/YABBY | | 2.10948 |
| SCCCLR1024F10.g | Transcription | Other Auxin-response factors With B3 domain | | 3.03055 |
| SCQGRZ3011D06.g | Transcription | Alfin-like | | 2.17274 |
| SCCCLR1048F03.g | Unknown protein | Chloroplast hypothetical protein | | 3.39922 |
| SCCCLR1068G11.g | DNA metabolism | Histone H2B | | 3.37772 |
| SCQSHR1023F08.g | Stress | Cytochrome P450 CYP71 | | 4.45371 |
| SCUTAM2088G02.g | Unknown protein | Putative GTP-binding protein | | 1.80345 |
| SCRFLR2037F09.g | Calcium | Calreticulin | | 2.87788 |
| SCCCLR1C03G01.g | Hormone biosynthesis | Jasmonic Acid Linoleic acid desaturase | | 3.49276 |
| SCUTST3129E01.g | Unknown protein | | | 1.93583 |
| SCQGHR1012B09.g | Stress | Probable cytochrome P450 monooxygenase | | 5.67878 |
| SCVPCL6041F12.g | Ubiquitination | Ubiquitin-specific protease | | 1.8455 |
| SCJLHR1028C12.g | Stress | Infected libraries Histone H4 | | 3.76242 |
| SCVPLR2005H03.g | Transcription | Aux/IAA | | 3.15361 |
| SCEQRT1031D02.g | Adapters | 14-3-3 proteins | | 2.23343 |
| SCCCCL3120C09.g | Receptors | Receptor Ser/Thr kinase cane RLK with LysM-1 | | 1.97526 |
| SCCCLR2C02A05.g | Development | Expansin | | 2.39903 |
| SCCCCL4003D08.g | Transcription | Zinc finger proteins C3H | | 1.90193 |
| SCSBSD2058D04.g | Ubiquitination | Ubiquitin | | 1.88495 |
| SCVPRT2074D04.g | Unknown protein | | | 6.8061 |
| SCCCRZ1001D02.g | Adapters | 14-3-3 proteins | | 2.70281 |
| SCMCST1053A06.g | Receptors | Receptor Ser/Thr kinase canePERK1-3 | | 2.4114 |
| SCCCLB2004C08.g | Ubiquitination | Ubiquitin | | 1.92442 |
| SCCCRZ1002F06.g | Stress | Drought and cold response Enolase | | 2.80387 |
| SCCCLR1022H07.g | Protein kinases | Cell cycle-related caneCDK-11 | | 2.39455 |
| SCCCRZ1001A09.g | Unknown protein | | | 1.97585 |
| SCSGAM1094D05.g | Hormone biosynthesis | Salicylic Acid | | 2.47418 |
| SCCCLR1024E11.g | Stress | Superoxide dismutases Cu/Zn | | 2.62077 |

TABLE XVII-continued

Genes differentially expressed between Internode 9 (mature rich in sugar)
Internode 1 (immature, poor in sugar) from a pool of seven low brix plants.
The individuals were selected from an F1 progeny of a cross between two commercial
varieties, SP80-180 and SP80-4966. RNA samples from internode 9 (mature, rich in sugar) and
internode 1 (immature, poor in sugar) were collected in March from the seven lowest brix
individuals and used to generate probes for cDNA microarray hybridizations. The column High
indicates the average ratios (fold induction) of genes more expressed in internode 9 than in
internode 1. The column Low indicates the average ratios (fold induction) of genes more
expressed in internode 1 than in internode 9. The average brix in the highest sugar internodes
was 13.66.

| SAS | Category | Description of homologue | High | Low |
| --- | --- | --- | --- | --- |
| SCCCRZ1C01H06.g | Calcium | Calmodulin-binding proteins Apyrase | | 3.09699 |
| SCQGLR2032G10.g | Ubiquitination | Polyubiquitin | | 1.63756 |
| SCACLR1057C07.g | Two component | Response regulators (ARR-like) | | 2.18371 |
| SCCCRZ2002C09.g | Others | Alpha tubulin | | 2.66313 |
| SCQGST1034G10.g | Protein kinases | Putative RLCK caneRLCK-AIV3 | | 2.34207 |
| SCBGFL4052C11.g | Transcription | EIL (ethylene-insensitive3-like) | | 1.73335 |

TABLE XVIII

Genes differentially expressed between Internode 9 (mature, rich in sugar) and
Internode 1 (immature, poor in sugar) from a pool of seven low brix plants.
The individuals were selected from an F1 progeny of a cross between two commercial
varieties, SP80-180 and SP80-4966. RNA samples from internode 9 (mature, rich in sugar) and
internode 1 (immature, poor in sugar) were collected in July from the seven lowest brix
individuals and used to generate probes for cDNA microarray hybridizations. The column High
indicates the average ratios (fold induction) of genes more expressed in internode 9 than in
internode 1. The column Low indicates the average ratios (fold induction) of genes more
expressed in internode 1 than in internode 9. The average brix in the highest sugar internodes
was 18.96.

| SAS | Category | Description of homologue | High | Low |
| --- | --- | --- | --- | --- |
| SCCCRZ2C04A07.g | Stress | Cytochrome P450 CYP71E | | 9.59342 |
| SCCCST1004A07.g | Protein kinases | SNF-like kinases cane osmotic stress-activated protein kinase-7 | | 2.37339 |
| SCCCLR1024E11.g | Stress | Superoxide dismutases Cu/Zn | | 2.21539 |
| SCCCCL5002B10.g | Protein kinases | Undefined-unclassified caneUPK-87 | | 2.15162 |
| SCCCRZ2C03D11.g | Transcription | Scarecrow | | 3.38429 |
| SCBFAD1046D01.g | Transcription | HLH (helix-loop-helix) | | 2.74633 |
| SCBFLR1039B05.g | Carbohydrate Metabolism | Xyloglucan endotransglycosylase | | 13.7587 |
| SCBGFL4053F12.g | Receptors | Receptor Ser/Thr kinase caneRLK-DV2 | | 4.08493 |
| SCEQRT1028H06.g | Hormone biosynthesis | Auxin Nitrilase | | 2.39496 |
| SCCCRT2001H11.g | Small GTPases | Arf | | 2.33013 |
| SCCCCL4004C06.g | Unknown protein | | | 4.61263 |
| SCCCRZ1C01H06.g | Calcium | Calmodulin-binding proteins Apyrase | | 8.66427 |
| SCCCRZ2C03B08.g | Unknown protein | | | 2.92174 |
| SCCCLR1001E04.g | Carbohydrate Metabolism | Photosynthesis RUBISCO - small subunit | | 4.99165 |
| SCSGFL5C08F04.g | Unknown protein | | | 17.9899 |
| SCUTAM2115C12.g | Unknown protein | | | 3.94798 |
| SCJLRZ1023H04.g | Protein kinases | SNF-like kinases caneCIPK-9 | | 4.18557 |
| SCMCFL5005A02.g | Stress | Glutathione peroxidases | | 2.65839 |
| SCVPRT2074D04.g | Unknown protein | | | 15.4127 |
| SCAGLR1021G10.g | Transcription | Homeobox knotted homeobox | | 2.46187 |
| SCJLLR1054C09.g | Transcription | Aux/IAA | | 2.43353 |
| SCEPRZ1009C10.g | Protein kinases | SNF-like kinases cane osmotic stress-activated protein kinase-1 | | 2.41081 |
| SCCCLR2C03D05.g | Stress | Superoxide dismutases Cu/Zn | | 3.06534 |
| SCRLAM1010D08.g | Transcription | Homeobox knotted homeobox | | 2.66789 |
| SCBFST3136A06.g | No matches | | | 1.73546 |
| SCRLFL3007C04.g | Receptors | Receptor Ser/Thr kinase caneRLK-D5 | | 3.92386 |
| SCCCHR1004H09.g | Others | Putative cholinephosphate cytidylyltransferase | | 1.67693 |
| SCCCRZ1001D02.g | Adapters | 14-3-3 proteins | | 2.07764 |
| SCEZRZ1012A02.g | Stress | Cytochrome P450 CYP9 | | 4.02698 |
| SCCCRZ1001G10.g | Transcription | Aux/IAA | | 4.19655 |
| SCCCCL3120C09.g | Receptors | Receptor Ser/Thr kinase cane RLK with LysM-1 | | 4.50352 |
| SCCCRZ2002C09.g | Others | Alpha tubulin | | 2.30687 |
| SCRUAD1063C06.g | Pathogenicity | Polygalacturonase-inhibiting | 1.85181 | |
| SCCCST2004D11.g | Receptors | Receptor Ser/Thr kinase cane RLK with lectin domain-2 | 6.70096 | |
| SCCCLR2002F08.g | Hormone related | Auxin auxin repressed | 1.67626 | |
| SCJFRZ2007F10.g | Development | ARC1 (arm repeat protein) | 2.00974 | |

TABLE XIX

Genes differentially expressed between Internode 5 (intermediately mature, rich in sugar) and Internode 1 (immature, poor in sugar) from a pool of seven high brix plants. The individuals were selected from a F1 progeny of a cross between two commercial varieties, SP80-180 and SP80-4966. RNA samples from internode 5 (Intermediate sugar) and internode 1 (Low sugar) were collected in July from the seven highest brix individuals and used to generate probes for cDNA microarray hybridizations. The column High indicates the average ratios (fold induction) of genes more expressed in internode 5 than in internode 1. The column Low indicates the average ratios (fold induction) of genes more expressed in internode 1 than in internode 5. The average brix in the highest sugar internodes was 22.63.

| SAS | Category | Description of homologue | High | Low |
|---|---|---|---|---|
| SCCCCL2001B01.b | Calcium | Calmodulin-binding proteins Apyrase | | 3.83704 |
| SCRLAM1010D08.g | Transcription | Homeobox knotted homeobox | | 2.47858 |
| SCEPLB1043H04.g | No matches | | | 2.03771 |
| SCRLFL3007C04.g | Receptors | Receptor Ser/Thr kinase caneRLK-D5 | | 2.19385 |
| SCJFRZ2032G01.g | Protein kinases | SNF-like kinases caneSnRK1-2 | | 2.49118 |
| SCRLSD1012E03.g | Ubiquitination | Ubiquitin | | 2.12917 |
| SCEQRT1033F01.g | Pathogenicity | Zinc finger proteins C2C2/Dof | | 7.73845 |
| SCVPLR1049E12.g | Small GTPases | Rab | | 2.20693 |
| SCCCCL4003D08.g | Transcription | Zinc finger proteins C3H | | 3.08079 |
| SCSBHR1050B11.g | Development | Putative senescence-associated protein | | 3.39882 |
| SCCCRT2001H11.g | Small GTPases | Arf | | 1.91729 |
| SCVPRT2074D04.g | Unknown protein | | | 9.59628 |
| SCJLLR1108H07.g | Calcium | Calmodulin-binding proteins ACA | | 2.13521 |
| SCEQRT1028H06.g | Hormone biosynthesis | Auxin Nitrilase | | 1.72814 |
| SCCCRZ1001G10.g | Transcription | Aux/IAA | | 2.77082 |
| SCRURT2010A10.g | Transcription | Putative transcription factor (myb) | | 2.08173 |
| SCSBSD2058D04.g | Ubiquitination | Ubiquitin | | 1.77273 |
| SCAGLR1021G10.g | Transcription | Homeobox knotted homeobox | | 2.61934 |
| SCCCLR1024F10.g | Transcription | Other Auxin-response factors With B3 domain | | 2.32277 |
| SCSFHR1043G09.g | Stress | Infected libraries S-adenosylmethionine synthase | | 2.3562 |
| SCCCLR1048F03.g | Unknown protein | Chloroplast hypothetical protein | | 20.3768 |
| SCEZLR1052E07.g | No matches | | | 1.59145 |
| SCCCRZ2C03D11.g | Transcription | Scarecrow | | 3.57548 |
| SCSGRT2066D05.g | Stress | Cytochrome P450 | | 3.17506 |
| SCCCRZ3002D03.g | Transcription | LIM (protein-protein interaction | | 5.10403 |
| SCVPRZ2038F04.g | Hormone biosynthesis | Jasmonic Acid Linoleic acid desaturase | | 2.7837 |
| SCCCLR1C03G01.g | Hormone biosynthesis | Jasmonic Acid Linoleic acid desaturase | | 2.1299 |
| SCUTLR1037F04.g | Others | Ankyrin repeat family protein Xa21 binding | | 2.00053 |
| SCCCCL5002B10.g | Protein kinases | Undefined-unclassified caseUPK-87 | | 2.09228 |
| SCCCLR1C05B07.g | Protein kinases | SNF-like kinases caneCIPK-3 | | 2.30631 |
| SCJFRZ2007F10.g | Development | ARCI (arm repeat protein) | | 16.2237 |
| SCEPLR1030B03.g | Pathogenicity | Tomato LRP protein | | 1.77057 |
| SCQGHR1012B09.g | Stress | Probable cytochrome P450 monooxygenase | | 2.2378 |
| SCCCCL3120C09.g | Receptors | Receptor Ser/Thr kinase case RLK with LysM-1 | | 1.69331 |
| SCEPRZ1009C10.g | Protein kinases | SNF-like kinases cane osmotic stress-activated protein kinase-1 | | 2.15245 |
| SCRUFL1112F04.b | Others | RNA stability UDP-GIcNAc | | 2.7596 |
| SCVPLR2027A05.g | Transcription | Other Auxin-response factors With B3 domain | | 2.55167 |
| SCCCRZ1001D02.g | Adapters | 14-3-3 proteins | | 2.02234 |
| SCVPRZ3025A12.g | Protein kinases | RLCK canePBS1-6 | | 2.16888 |
| SCJLRZ1023H04.g | Protein kinases | SNF-like kinases caneCIPK-9 | | 3.53497 |
| SCEQRT2099H01.g | Protein kinases | Calcium-related caneCDPK-27 | | 1.84964 |
| SCCCRZ1001H05.g | Transcription | HLH (helix-loop-helix) | | 4.52862 |
| SCMCCL6055H06.g | Pathogenicity | Tomato LRP protein | | 1.96121 |
| SCCCRZ1002F06.g | Stress | Drought and cold response Enolase | | 2.22871 |
| SCCCLR1048D07.g | Hormone biosynthesis | Salicylic Acid | | 14.2767 |
| SCCCRZ1C01H06.g | Calcium | Calmodulin-binding proteins Apyrase | | 4.7337 |
| SCSGAM1094D05.g | Hormone biosynthesis | Salicylic Acid | | 5.14944 |
| SCCCLR1072E03.g | Receptors | Receptor Ser/Thr kinase caneRLK-AX3 | | 2.08456 |
| SCSGFL5C08F04.g | Unknown protein | | | 10.083 |
| SCCCRZ2C04A07.g | Stress | Cytochrome P450 CYP71E | | 4.14116 |
| SCUTAM2088G02.g | Unknown protein | Putative GTP-binding protein | | 1.82251 |
| SCCCLR1C04G08.g | Protein kinases | Casein kinases caneCKI-3 | | 4.08444 |
| SCUTLR2008E01.g | No matches | | 1.84352 | |
| SCQSRT1036D03.g | Pathogenicity | R-genes transduction PR | 2.02071 | |
| SCRLST3166F11.g | No matches (non-coding) | | 1.63126 | |
| SCEQLB1065H07.g | No matches | | 2.42131 | |
| SCRLAD1100E08.g | No matches | | 2.36751 | |
| SCRUAD1133D10.b | Receptors | Photoreceptors Blue light receptor cry1 | 2.95879 | |
| SCCCLR1001D10.g | Transcription | Putative AP2-domain transcription factor | 2.30605 | |
| SCSBHR1056H08.g | Receptors | EIN2 (ethylene) | 4.24768 | |
| SCCCLR1C07B07.g | Others | Glycine-rich RNA-binding protein | 1.84253 | |
| SCCCRZ2C03B03.g | Receptors | Receptor Ser/Thr kinase cane RLK wish LysM-2 | 1.76512 | |
| SCCCLR2001H09.g | Stress | Thioredoxin | 2.00805 | |
| SCRLFL1008C11.g | No matches | | 2.48511 | |

TABLE XX

Genes differentially expressed between Internode 5 (intermediately mature, rich in sugar) and Internode 1 (immature, poor in sugar) from a pool of seven low brix plants. The individuals were selected from a F1 progeny of a cross between two commercial varieties, SP80-180 and SP80-4966. RNA samples from internode 5 (Intermediate sugar) and internode 1 (Low sugar) were collected in July from the seven lowest brix individuals and used to generate probes for cDNA microarray hybridizations. The column High indicates the average ratios (fold induction) of genes more expressed in internode 5 than in internode 1. The column Low indicates the average ratios (fold induction) of genes more expressed in internode 1 than in internode 5. The average brix in the highest sugar internodes was 18.96.

| SAS | Category | Description of homologue | High | Low |
|---|---|---|---|---|
| SCCCST1004A07.g | Protein kinases | SNF-like kinases cane osmotic stress-activated protein kinase-7 | | 2.24911 |
| SCVPLR2027A05.g | Transcription | Other Auxin-response factors With B3 domain | | 1.92017 |
| SCEZRZ1012A02.g | Stress | Cytochrome P450 CYP9 | | 2.66254 |
| SCBFLR1039B05.g | Carbohydrate Metabolism | Xyloglucan endotransglycosylase | | 6.00106 |
| SCCCRZ1001G10.g | Transcription | Aux/IAA | | 1.58291 |
| SCEQRT1033F01.g | Pathogenicity | Zinc finger proteins C2C2/Dof | | 2.69468 |
| SCCCRZ1C01H06.g | Calcium | Calmodulin-binding proteins Apyrase | | 4.50294 |
| SCSBAM1084F08.g | Unknown protein | Similar to cyclin | | 4.00643 |
| SCCCLR1001E04.g | Carbohydrate Metabolism | Photosynthesis RUBISCO - small subunit | | 2.99228 |
| SCSGAM1094D05.g | Hormone biosynthesis | Salicylic Acid | | 3.03142 |
| SCCCLR1048D07.g | Hormone biosynthesis | Salicylic Acid | | 3.86262 |
| SCSGFL5C08F04.g | Unknown protein | | | 7.37235 |
| SCCCRZ3002D03.g | Transcription | LIM (protein-protein interaction) | | 3.27664 |
| SCVPRT2074D04.g | Unknown protein | | | 9.96472 |
| SCRURT2010A10.g | Transcription | Putative transcription factor (myb) | | 1.75219 |
| SCCCRZ2C03D11.g | Transcription | Scarecrow | | 2.57578 |
| SCRLFL3007C04.g | Receptors | Receptor Ser/Thr kinase caneRLK-D5 | | 2.6318 |
| SCCCCL4004C06.g | Unknown protein | | | 2.12353 |
| SCJFRZ2007F10.g | Development | ARC1 (arm repeat protein) | | 4.00615 |
| SCCCLR1048F03.g | Unknown protein | Chloroplast hypothetical protein | | 3.74571 |
| SCCCRZ2C04A07.g | Stress | Cytochrome P450 CYP71E | | 7.42158 |
| SCSGRT2066D05.g | Stress | Cytochrome P450 | | 2.16937 |
| SCBGLR1117A05.g | Small GTPases | Ran | 1.86344 | |
| SCCCLR1C04E03.g | Ubiquitination | E2 | 1.56768 | |
| SCSBAD1084C01.g | Others | Tubulin alpha-1 chain | 1.72259 | |
| SCMCLR1123E10.g | Others | T-complex protein (chaperonin) | 2.39987 | |
| SCVPLR2012B07.g | Two component | Phosphorelay intermediate Similar to ATHP1 ATHP2 ATHP3 | 2.91613 | |
| SCQGLR1019A10.g | Small GTPases | Ran | 2.08538 | |
| SCQSRT1036D03.g | Pathogenicity | R-genes transduction PR | 1.86776 | |
| SCCCLR2001H09.g | Stress | Thioredoxin | 2.43049 | |
| SCRFFL5034G07.g | No matches | | 2.21962 | |
| SCCCLR2002F08.g | Hormone related | Auxin auxin repressed | 1.78828 | |
| SCCCLR1C07B07.g | Others | Glycine-rich RNA-binding protein | 2.24474 | |
| SCJFAM1066B05.g | Transcription | HIT (histidine triad) PKC inhibitor | 1.85085 | |
| SCCCRT2002B03.g | Protein metabolism | Putative ribosomal protein S14 | 2.48804 | |
| SCRLLR1111D02.g | No matches (non-coding) | | 1.70582 | |
| SCCCCL4007H07.g | No matches | | 1.9409 | |
| SCJFHR1C03E01.b | Protein kinases | Undefined canePK-BII3 | 1.60982 | |
| SCCCFL4091A07.g | Hormone related | Giberellin Giberellin responsive | 1.79817 | |
| SCJFRT1062G05.g | Transcription | CCAAT | 1.68245 | |
| SCCCRZ2001F06.g | Protein metabolism | Putative 6S ribosomal protein L11 | 2.1963 | |
| SCSBSD2029F05.g | Unknown protein | | 5.22372 | |
| SCJFRZ2028F11.g | Receptors | Receptor Ser/Thr kinase caneSERK-5 | 2.07098 | |
| SCCCRZ2003E12.g | Transcription | bZIP | 1.7904 | |
| SCUTLR2008E01.g | No matches | | 2.06397 | |
| SCCCST3C01D11.g | Receptors | Receptor Ser/Thr kinase-unclasssified caneURLK-84 (with LRR) | 1.97063 | |
| SCSBSD2029D11.g | No matches | | 1.77589 | |
| SCEQLR1091A10.g | Protein metabolism | 60S Ribosomal protein L23 | 2.04218 | |
| SCCCLR2001E10.g | No matches | | 1.96151 | |
| SCQSSB1077D06.g | Receptors | Receptor Ser/Thr kinase caneRLK-DXII4 | 2.11245 | |
| SCEZHR1087F06.g | Stress | Cytochrome P450 CYP84 | 1.72424 | |
| SCRLFL1008C11.g | No matches | | 2.58471 | |
| SCEZLR1009F06.g | Carbohydrate metabolism | Pyruvate dehydrogenase | 2.60268 | |
| SCCCCL4004A10.g | Others | Putative polyprotein | 1.97711 | |
| SCJFLR1013A09.g | Stress | Drought and cold response Cysteine proteinase RD19A precursor | 2.11721 | |
| SCSBHR1056H08.g | Receptors | EIN2 (ethylene) | 3.47771 | |
| SCCCLR1001D10.g | Transcription | Putative AP2-domain transcription factor | 1.884 | |
| SCCCRZ2002C09.g | Others | Alpha tubulin | 1.84438 | |

TABLE XXI

An example of genes that are differentially expressed both when High and Low Brix plants are compared and when Mature (Internode 9) and Immature (Internode 1) internodes are compared. Data indicated with an asterisk has been published by Felix J. M. (2006).

| SAS | category | sub category 1 | sub category 2 | High vs Low brix | Internode 9 vs Internode 1 |
|---|---|---|---|---|---|
| SCRFLR2037F09.g | Calcium | Calreticulin | | Down High Brix | Down Mature Internode |
| SCCCRT1001E01.g | Hormone biosynthesis | Jasmonic Acid | Lipoxygenase | Down High Brix | Down Mature Internode* |
| SCCCLR2002F08.g | Hormone related | Auxin | auxin repressed | Down High Brix | Down Mature Internode |
| SCRFLR1012F12.g | Others | caffeic acid 3-O-methyltransferase | | Up High Brix | Up Mature Internode* |
| SCSFAD1125C08.g | Pathogenicity | Polygalacturonase-inhibiting | | Down High Brix | Down Mature Internode* |
| SCCCLR2C01G07.g | Protein kinases | SNF-like kinases | caneCIPK-20 | Up High Brix | Up Mature Internode* |
| SCMCRT2103B04.g | Protein kinases | SNF-like kinases | caneCIPK-21 | Up High Brix | Up Mature Internode* |
| SCEPRZ1010E06.g | Protein Phosphatases | Serine/Threonine - PPM Family | PP2C-like | Down High Brix | Down Internode* |
| SCCCLR2C01F06.g | Stress | Wound-induced | | Up High Brix | Up Mature Internode* |
| SCJLRT1021D12.g | Stress | Wound-induced | Chalcone synthase | Down High Brix | Down Internode* |
| SCJFRT1005C11.g | Hormone biosynthesis | Ethylene | ACC oxidase | Up High Brix | Down Mature Internode* |
| SCVPLR2012A10.g | Hormone biosynthesis | Ethylene | ACC oxidase | Up High Brix | Down Mature Internode* |
| SCCCLR1048D07.g | Hormone biosynthesis | Salicylic Acid | | Up High Brix | Down Mature Internode |
| SCEQRT1024E12.g | Hormone biosynthesis | Salicylic Acid | | Up High Brix | Down Mature Internode* |
| SCCCLR1C02F07.g | Inositol | Others | myo-Inositol-1-phosphate synthase | Up High Brix | Down Mature Internode* |
| SCEZHR1087F06.g | Stress | Cytochrome P450 | CYP84 | Down High Brix | Up Mature Internode |
| SCAGFL1089C03.g | Stress | Glutathione S-transferases | | Up High Brix | Down Mature Internode* |
| SCCCCL3002C09.b | Stress | Glutathione S-transferases | | Up High Brix | Down Mature Internode* |

Genes of this Invention

The invention provides polynucleotides described above and their variants.

Variants

"Variants" is intended to include substantially similar polynucleotide sequences, as long as they still have a same or substantially similar function as polynucleotides of this invention, e.g., marker for plants with different sugar content, ability to modulate sugar content. Common sources for variants include sequence identity variants, fragments, hybridizing sequences, complements, or mutated sequences. A fragment of the sequence is defined as a portion or region of the sequence that can be used to alter the expression levels of one of the genes encoding SEQ ID Nos. 1-203 or 229 to 373 in transgenic plants.

Sequence Identity

Naturally and non-naturally occurring "variants" of differentially expressed sequences within the invention include nucleic acid molecules having at least about 65%, 70%, 75%, 80%, 85%, 90%, or 95% sequence identity with the native sugarcane sequences disclosed herein, i.e., SEQ ID Nos. 1-203 or 229 to 373, or complements of these sequences. More preferably, the variants have 97%, 98%, 99%, or at least about 99.5% sequence identity to the whole sequence or a fragment of the sequence. Comparisons for determination of sequence identity can be made using methods known to those of skill in the art.

Hybridization

"Variants" also include nucleic acids molecules that hybridize under high stringency conditions, as defined herein, to the sugarcane nucleic acid sequences of SEQ ID Nos. 1-203 or 229 to 373 or the complement of the sequences of SEQ ID Nos. 1-203 or 229 to 373. For example, such "variants" may be nucleic acid molecules that hybridize to the sequence of SEQ ID Nos. 1-203 or 229 to 373 or the complement of the sequences of SEQ ID Nos. 1-203 or 229 to 373 under low stringency conditions, moderate stringency conditions, or high stringency conditions. (See Sambrook et al. (Most recent edition) Molecular Cloning: A Laboratory Manual, Cold Spring Harbor Laboratory Press, Cold Spring Harbor, N.Y.).

As used herein, the phrase "low stringency hybridization conditions" refers the following conditions and equivalents thereto: hybridization at 5×SSC, 2% SDS, and 100 µg/ml single stranded DNA at 40° C. for 8 hours, followed by at least one wash in 2×SSC, 0.2% SDS, at 40° C. for thirty minutes. As used herein, the phrase "moderate stringency hybridization conditions" refers the following conditions and equivalents thereto: hybridization at 5×SSC, 2% SDS, and 100 µg/ml single stranded DNA at 50° C. for 8 hours, followed by at least one wash in 0.1×SSC, 0.1% SDS, at 50° C. for thirty minutes. As used herein, the phrase "high stringency hybridization conditions" refers the following conditions and equivalents thereto: hybridization at 5×SSC, 2% SDS, and 100 µg/ml single stranded DNA at 65° C. for 8 hours, followed by at least one wash in 0.1×SSC, 0.1% SDS, at 65° C. for thirty minutes.

Complements

Alternatively, nucleic acids of this invention are those having a nucleotide sequence that is the complement of the full-length or portions of the sequences of SEQ ID Nos. 1-203 or 229 to 373.

Polynucleotides can be as short as 14 nucleotides, but they are not restricted to this length.

Mutants

The genes can also be mutated by radiation or chemical mutagenesis using EMS (ethylmethane sulfonate) and mutated alleles identified by Tilling or RFLP generating plants with increased sucrose content through non-transgenic methodologies.

One or more point mutations can be introduced into a nucleic acid molecule to yield a modified nucleic acid molecule using, for example, site-directed mutagenesis (see Wu (Ed.), Meth. In Enzymol. Vol. 217, San Diego: Academic Press (1993); Higuchi, "Recombinant PCR" in Innis et al. (Ed.), PCR Protocols, San Diego: Academic Press, Inc. (1990), each of which is incorporated herein by reference). Such mutagenesis can be used to introduce a specific, desired amino acid insertion, deletion or substitution; alternatively, a nucleic acid sequence can be synthesized having random nucleotides at one or more predetermined positions to generate random amino acid substitutions. Scanning mutagenesis also can be useful in generating a modified nucleic acid molecule encoding substantially the amino acid sequence as polypeptides of this invention.

Polypeptides of this Invention

In certain embodiments, this invention provides polypeptides partially or fully encoded by the polynucleotides of this invention or by variants of a polynucleotide of this invention.

In other embodiments, the polypeptide has an amino acid sequence substantially similar to that encoded by polynucleotides of this invention. As used herein, the term "substantially the same amino acid sequence," is intended to mean a polypeptide or polypeptide segment having an identical amino acid sequence, or a polypeptide or polypeptide segment having a similar, non-identical sequence that is considered by those skilled in the art to be a functionally equivalent amino acid sequence. In particular, polypeptide with "substantially the amino acid sequence" can have one or more modifications such as amino acid additions, deletions or substitutions, including conservative or non-conservation substitutions.

Comparison of sequences for substantial similarity can be performed between two sequences of any length and usually is performed with sequences between about 6 and 1200 residues, preferably between about 10 and 100 residues and more preferably between about 25 and 35 residues. Such comparisons for substantial similarity are performed using methodology routine in the art.

The preferred percentage of sequence similarity for polypeptides includes polypeptides having at least about 65% similarity, 70% similarity, 75% similarity, 80% similarity, 85% similarity, 90% similarity, 95% similarity, 97% similarity, 98% similarity, 99% similarity, or more preferably at least about 99.5% similarity.

Sequence similarity is preferably calculated as the number of similar amino acids in a pairwise alignment expressed as a percentage of the shorter of the two sequences in the alignment. The pairwise alignment is preferably constructed using the Clustal W program, using the following parameter settings: fixed gap penalty=10, floating gap penalty=–0, protein weight matrix=BLOSUM62. Similar amino acids in a pairwise alignment are those pairs of amino acids which have positive alignment scores defined in the preferred protein weight matrix (BLOSUM62). The protein weight matrix BLOSUM62 is considered appropriate for the comparisons described here by those skilled in the art of bioinformatics. (The reference for the clustal w program (algorithm) is Thompson, J. D., Higgins, D. G. and Gibson, T. J. (1994) CLUSTAL W: improving the sensitivity of progressive multiple sequence alignment through sequence weighting, positions-specific gap penalties and weight matrix choice. Nucleic Acids Research, 22:4673-4680; and the reference for BLOSUM62 scoring matrix is Henikoff, S, and Henikoff, J. G. (1993) Performance evaluation of amino acid substitution matrices. Proteins, 7:49-61.)

It is understood that minor modifications of primary amino acid sequence can result in a polypeptide that has substantially equivalent or enhanced function polypeptides of this invention. Further, various molecules can be attached to polypeptide thereof, for example, other polypeptides, antigenic or other peptide tags, carbohydrates, lipids, or chemical moieties.

Sugarcane Plants for Identification of Genes of this Invention

A—Crossings

1—An Example of Characterization of a Progeny Derived from Wild-Type Ancestors:

Two initial intra-specific polycrosses could be performed, one among *Saccharum officinarum* genotypes and the other combining *Saccharum spontaneum* genotypes. The crossing and selection process that could follow is illustrated in FIG. 1. For each generation 500 individuals could be sampled for brix content and gene expression and the extreme segregants selected. The hybrid individuals selected for molecular studies could be planted in the field in one row of 5 meters using standard sugarcane cultivation practices. Brix readings and tissue samples could be collected very early in the season, in March of the following year, when plants were 10 months. For brix content determination plants could be sampled by using a hand held juice sample collector. Juice could be collected by punching a hole in the middle of the $5^{th}$ visible internode counted from the top after removal of the lowest dry leaf sheath still attached to the culm. A few drops of the juice could be placed in a handheld refractometer (N1, ATAGO, Japan) and a direct brix reading obtained. Individuals or pools of individuals (for example, seven or eight individuals) can have their tissues collected and RNA extracted.

2—Examples of a Progeny Derived from Commercial Varieties:

Five hundred sugarcane F1 plants from a cross between two commercial varieties (SP80-180×SP80-4966, or SP80-144×SP85-7215) could be kept in a green house or field-grown. They could segregate for stem sugar content in a normal manner and the seven plants presenting extreme values for gene expression associated to high sugar and low sugar could be selected. Mature leaves (Leaf+1, Van Dillewijn, 1952), immature leaf, mature internode, immature and intermediate internode, root, lateral bud and a mix of flowers in different developmental stages could be collected from the selected plants 6, 7, 9, 11 and 13 months after planting (but not restricted to). Tissues collected at each time point could be pooled from seven individuals of each group or characterized for each individual sample. For RNA blot analysis all time points could be evaluated, or only one time point could be evaluated. Gene expression profiles could be analyzed independently, using three individuals from each group (for example), or be determined for a group of plants.

B—Commercial Varieties or Cultivars

Varieties can be field-grown for a year (for example, since September) and samples collected throughout the year (for example in March, May, July or September, but not restricted to). Tissue samples can be collected from 2 to 4 individuals of each variety which are pooled or analyzed independently. Examples of varieties that have been shown to have altered expression for the genes are the high sucrose and precocious accumulating cultivars SP91-1049 and SP89-1115 in comparison to the low sucrose and late accumulating cultivars SP83-2847 and SP94-3116. Samples can be collected as described above.

Methods for Determining the Ability of a Plant to Accumulate Sugar

In certain embodiments, this invention uses genes that are differentially expressed in plants having different sugar levels, such as SEQ ID NO:s 1 to 203 and SEQ ID NO:s 229 to 373, to determine the ability of the plant to accumulate sugar. In some embodiments, the expression level of genes is measured using various methods known in the art, such as those described below. In other embodiments, the expression level of the polypeptide expressed by polynucleotides of this invention is detected.

Measurement of Gene Expression

Gene expression can be determined using any technique that will measure the product of the gene's activity, for example transcript or mRNA levels or protein levels, including cDNA microarrays, oligonucleotide arrays or gene chips, quantitative PCR, northern blots, western blots/ELISA/mass spectrometry, according to the methods described in this work.

Gene expression can be measured by various methods, including:
quantitative PCR
real-time PCR
cDNA microarrays
oligonucleotide arrays or gene chips
northern blots
any technique that will measure transcript levels for genes such as NASBA or TMA
any technique that will use hybridization of genes or of a product of the gene as a measure of gene expression any technique that will measure a product of gene expression such as the protein encoded by the genes such as with the aid of an antibody (as in western blots and ELISA) or mass spectrometry.

cDNA Microarrays

Tissue Sampling and RNA Extraction from Sugarcane Plants

The first leaf with a visible dewlap (leaf+1) and internodes 1, 2, 5 and 9 (counted from top to bottom where number 1 was the smallest visible internode after all leaves were removed) can be collected from 6 to 18 month old plants. The internodal tissue can be separated from the node, cut in small pieces, frozen in liquid nitrogen, and stored at −80° C. Internodes 1 and 2 can be pooled prior to RNA extraction and are referred as internode 1. Frozen tissues can be grinded using a homogenizer. 2-2.5 g were weighted and grinded to a fine powder, in liquid nitrogen, using pre-cooled mortar and pestle. The pulverized tissue will be transferred to a 50 ml tube and homogenized with 5 ml Trizol® (Invitrogen) per gram of tissue. The manufacturer's recommendations for high polysaccharide content tissues will be followed for the mature internode samples. Samples can be incubated for 5 min at room temperature (RT), with occasional vortexing. The homogenate will be centrifuged at 3,000 rpm; 4° C. for 10 min and the supernatant transferred to a new 50 ml tube. 0.2 ml of chloroform (RT) will be added for each ml of Trizol® solution. The solution will be mixed vigorously for 15 s and incubated for 3 min at RT. After centrifugation (3,000 rpm, 4° C., 15 min), the aqueous phase will be transferred to tubes containing 0.6 volumes of isopropanol. The solution will be mixed several times by gentle inversion and incubated at RT for 10 min. Tubes will be centrifuged at 10,000 rpm, 4° C. for 10 min and the supernatant was carefully discarded. Pellets will be washed with cold 75% ethanol. Samples will be briefly vortexed and centrifuged at 6,000 rpm for 5 min. The supernatant can be again discarded and pellets washed with cold 100% ethanol. After centrifugation, the supernatant will be discarded and pellets were allowed to dry at RT for at least 10 min. Pellets will be resuspended in 20 µl of warm diethyl pyrocarbonate-treated water, vortexing gently for about 15 min. RNA samples can be quantified in a spectrophotometer and loaded on 1.0% agarose/formaldehyde gels for quality inspection.

PCR Amplification and Array Printing

Sugarcane cDNA plasmid clones of 6438 ESTs obtained from the SUCEST collection can be re-arranged and amplified in 100 µl PCR reactions (40 cycles, annealing at 51° C.), directly from bacterial clones in culture, using T7 and SP6 primers. For this work, clones had their identity validated by re-sequencing. PCR products can be purified by filtration using 96 well filter plates (Millipore Multiscreen® MAFBN0B50). Samples can be visualized on 1% agarose gels to inspect PCR-amplification quality and quantity. Purified PCR products (in 10 mM Tris-HCl pH 8.0 solution) can be mixed with an equal volume of DMSO in 384 well V-bottom plates. Microarrays can be constructed by arraying cDNA fragments on DMSO optimized, metal coated glass slides (type 7, Amersham Biosciences) using the Generation III Microarray Spotter(Molecular Dynamics/Amersham Pharmacia Biotech). Each cDNA fragment was spotted for this work on the slides at least four times (i.e., technical replicates). Following printing, the slides will be allowed to dry and the spotted DNA was bound to the slides by UV-cross linking (50 mJ).

Probe Preparation and Hybridization

Ten micrograms of total RNA can be reverse transcribed, labeled, and hybridized using the reagents provided with the CyScribe Post-Labeling kit (Amersham Biosciences), according to the manufacturer's instructions. The products of the labeling reactions can be purified in Millipore Multiscreen® filtering plates to remove unincorporated labeled nucleotides. Microarrays can be co-hybridized with the fluorescently labeled probes. Hybridizations were performed overnight at 42° C. in humid chambers. The slides can be then washed in 1×SSC and 0.2% SDS (10 min, 55° C.), twice in 0.1×SSC and 0.2% SDS (10 min, 55° C.), and in 0.1×SSC (1 min, RT). Slides will then be rinsed briefly in filtered milli-Q water and dried with a nitrogen stream.

Data Acquisition, Processing and Statistical Analysis

Slides can be scanned using the Generation III Scanner™ (Molecular Dynamics) adjusting the photomultiplier tube (PMT) to 700 for both channels. Images can be processed and data collected using the ArrayVision (Imaging Research Inc.) software. For this work, local median background was subtracted from the MTM (median-based trimmed mean) density for each spot. Data from clones that generated poor-quality PCR fragments (no amplification or unspecific bands) or poor-quality spots (visually inspected) were excluded. The data were stored and managed by the BioArray Software environment[14] free web-based database.

A set of custom programs based on R language were developed for data processing based on methods described previously (Papini-Terzi et al., 2005). Pearson correlation values among the samples were calculated using normalized expression ratios obtained from high sugar samples against low sugar samples or test samples versus pool of samples hybridizations for 6438 genes. We used homotypic or 'self-self' hybridizations of the reference pool sample to define intensity-dependent cutoff levels that would indicate differentially expressed genes. The identification of differentially expressed genes was performed using a local implementation of the HTself method (Vencio and Koide, 2005; available at blasto.iq.usp.br/~rvencio/HTself), that uses "self-self" hybridizations to derive an intensity-dependent cut-off for significant fold-changes integrating the probability density function to 98% for different signal intensity levels. The SAS (Sugarcane Assembled Sequences) presenting more than 70% of its replicates outside fold-change cut-off curves were defined as differentially expressed. The fluorescence ratios were normalized to account for systematic errors using the LOWESS fitting (Yang et al. 2002) and used to calculate the expression ratios for all genes between the tissue sample and the reference sample. For every gene, the percentage of replicates within or outside the cutoff limits was calculated in each tissue sample. Further details on the method are available on the World Wide Web at sucest-fun.org/pub/SUCAST.

Other methods that compare an expression pattern to another or score a change from expressed to non-expressed, or the reverse are useful. Changes in intensity of expression may be scored, either increases or decreases. Any statistically significant change can be used. Typically changes in one of SEQ ID NO. 1-203 are suitable. However, more genes may be usefully analyzed. SEQ ID NO. 1-203 gene expression data can be used as molecular classifiers or used to train methods to distinguish between high and low sucrose plants or populations of plants using a variety of established techniques such as the Fisher's linear discriminant analysis (Meireles et al., 2004), the Prediction Analysis of Microarrays software PAM (Tibshirani et al., 2002) or commonly used methods as SVM (Support Vector Machines) or LVQ (Learning Vector Quantization) (Mattfeldt et al., 2004). By doing so, SEQ ID NO. 1-203 expression profile can be used to predict between high brix and low brix plants and can be used to classify the individuals of a progeny or cultivars. Genes whose expression were found to be unaltered in the microarray experiments can aid in defining classes and be used to train the algorithms, together with the differentially expressed SEQ ID NO. 1-203. Table XI lists as an example 25 SAS (SEQ ID NO. 204 to 228) and the corresponding ESTs that are consistently expressed in similar levels in all samples analyzed (high and low brix).

TABLE XI

Twenty-five genes not differentially expressed between all the high and all the low brix populations and varieties.

The SAS (Sugarcane Assembled Sequences) and corresponding ESTs presenting more than 70% of its replicates inside fold-change cut-off curves were defined as not differentially expressed and can be used as controls in real-time PCR reactions or to train classification algorithms.

SEQ ID NO. 204: SCAGLR1043C02.g
(CA291199, CA126773, CA103634, CA278537, CA291283, CA105620, CA129564, CA135982,
CA154949, CA137234, CA131175, CA131096, CA267022, CA136766, CA079897, CA112911,
CA202743, CA212218, CA130074, CA116962, CA300529, CA233427, CA275519, CA215010,
CA190793, CA264955, CA275590, CA148445, CA276733, CA197411, CA285562, CA143450,
CA158699, CA148266, CA276787, CA223611, CA131410, CA129260, CA282689, CA143509,
CA127374, CA223701, CA107631, CA102547, CA200880, CA126777, CA168082, CA143088, CA139235)

SEQ ID NO. 205: SCAGRT3046D01.g
(CA300723, CA294382, CA264769, CA294452)

SEQ ID NO. 206: SCBGLR1002006.g
(CA278315, CA117650, CA127739, CA212804, CA073244, CA138816, CA152521, CA152509,
CA153113, CA283276, CA259474, CA289253, CA101319, CA126194, CA187565, CA093995,
CA150472, CA252354, CA226461, CA286965, CA142703, CA298971, CA286850, CA111071,
CA128235, CA130953, CA283578, CA181244, CA190282, CA241875, CA076812)

SEQ ID NO. 207: SCCCCL3005D01.b
(CA271043, CA272368, CA215896, CA098903, CA093456, CA150890, CA266868, CA263152,
CA093454, CA284141, CA270967, CA070480, CA223204, CA261258)

SEQ ID NO. 208: SCCCCL3080C09.g
(CA259330, CA152240, CA289512, CA124276, CA269953, CA282554, CA150365, CA076742,
CA124252, CA125409, CA189780, CA150360, CA067168, CA185260, CA268877, CA287161,
CA079640, CA180418, CA284801, CA268954, CA296365, CA118827, CA184393, CA289786,
CA111364, CA150081, CA229568, CA200556, CA120906, CA286941, CA225985, CA285992,
CA255183, CA262927, CA277963, CA103076, CA118794, CA118790, CA103799, CA129390,
CA286405, CA100864, CA129384, CA074893, CA093506, CA214051, CA129364, CA111366,
CA152568, CA076728, CA074983, CA124214, CA093579, CA122181, CA071338, CA249655,
CA152647, CA128317, CA131033, CA071425, CA077256, CA117737, CA078093, CA199165,
CA168557, CA125328, CA084326, CA150876, CA082480, CA254028, CA189858, CA276734,
CA118424, CA268830, CA231681, CA276788, CA117438, CA225602, CA277928, CA114620,
CA247257, CA185669, CA076943, CA075590, CA202758)

SEQ ID NO. 209: SCCCCL7001A04.g
(CA100620, CA223268, CA100961, CA199955, CA223191, CA279575, CA103970, CA110326)

SEQ ID NO. 210: SCCCLB1C03B04.g
(CA086997, CA198468, CA164949, CA299431, CA189172, CA279831, CA175292, CA190805,
CA155239, CA074671, CA131422, CA172088, CA237966, CA113643, CA099312, CA097078, CA168581)

SEQ ID NO. 211: SCCCLR1022H01.g
(CA119702, CA189837, CA274251, CA124160, CA152830, CA202385, CA214786, CA223178,
CA094030, CA092004, CA283613, CA277116, CA146444, CA297712, CA223255, CA067746,
CA116394, CA067839, CA297889)

SEQ ID NO. 212: SCCCLR1070B11.g
(CA194863, CA069696, CA120150, CA067031, CA087323, CA292894, CA165329, CA185869,
CA168662, CA064663, CA256320, CA079508, CA064662, CA209676)

TABLE XI-continued

Twenty-five genes not differentially expressed between all the high and all the low brix populations and varieties.

SEQ ID NO. 213: SCCCLR1072A03.g
(CA257676, CA241502, CA103767, CA119541, CA212813, CA072979, CA076246, CA260516,
CA173103, CA092491, CA279357, CA076330, CA298956, CA235977, CA283443, CA067187,
CA172026, CA102965, CA243748, CA157421, CA254836, CA086831, CA067267, CA254991,
CA165072, CA254121, CA281218, CA194801, CA107489, CA241226, CA183169, CA259059,
CA110302, CA074064, CA211578, CA259058, CA241304, CA222499, CA167440, CA166656,
CA103379, CA092495, CA251886, CA198331, CA197814, CA095062, CA089849, CA181078,
CA238993, CA080070, CA160829, CA257963, CA077196, CA244970, CA085039, CA170461,
CA159351, CA272807, CA245352, CA107493, CA159440)

SEQ ID NO. 214: SCCCLR1075G05.g
(CA064776, CA104174, CA262368, CA073013, CA168309, CA121412, CA226304, CA230815,
CA129021, CA299276, CA123604, CA267396, CA263329, CA120286, CA177583, CA147731,
CA264721, CA123599, CA263403, CA194813, CA241253)

SEQ ID NO. 215: SCCCLR1078F05.g
(CA124384, CA112238, CA228635, CA253815, CA228634, CA120519, CA228633, CA088403,
CA284381, CA153412, CA257810, CA243271, CA089170)

SEQ ID NO. 216: SCCCNR1001B12.g
(CA282544)

SEQ ID NO. 217: SCCCRZ2002E06.g
(CA079679, CA231568, CA121168, CA149726, CA278060, CA136300)

SEQ ID NO. 218: SCCCRZ2C04B04.g
(CA246886, CA220871, CA154329, CA280029, CA268704, CA150217, CA219829, CA268689,
CA068008, CA068007, CA117830, CA087866, CA261807, CA268749, CA156666, CA205929,
CA158955, CA167141, CA239715)

SEQ ID NO. 219: SCEPAM1020E03.g
(CA072822, CA072801, CA188039, CA072796)

SEQ ID NO. 220: SCEQRT1024H10.g
(CA139099, CA281552, CA281378, CA132555, CA287054, CA251801, CA132401, CA143578,
CA284175, CA143345, CA143889, CA284251, CA143429, CA143390, CA284886, CA296940,
CA143494, CA139010, CA138862, CA300775, CA143467, CA134226, CA277302, CA141676,
CA285542, CA142420, CA258267, CA267581, CA130719, CA274036, CA267666, CA144676,
CA278111)

SEQ ID NO. 221: SCEQRT1030A03.g
(CA228274, CA133004, CA230581, CA230389, CA230510, CA235035, CA197298, CA088047)

SEQ ID NO. 222: SCJFRT1009A08.g
(CA133624, CA190354)

SEQ ID NO. 223: SCJFRZ2009G01.g
(CA088829, CA075098, CA139326, CA272034, CA075189, CA151398, CA276729, CA223035,
CA237807, CA111462, CA106723, CA213636, CA123369, CA135723, CA244358, CA246251,
CA226436, CA190274, CA123851, CA244439, CA132084, CA178674, CA113343)

SEQ ID NO. 224: SCJLFL3014C10.g
(CA227690, CA227772)

SEQ ID NO. 225: SCMCCL6055H06.g
(CA183309, CA272155, CA071587, CA154790, CA236184, CA111608, CA231710, CA288208,
CA098251, CA238333, CA187031, CA071503, CA293423)

SEQ ID NO. 226: SCQGLR1019C05.g
(CA239321, CA259641, CA170537, CA094369, CA124046, CA147545, CA082777, CA187852,
CA199413, CA154540, CA169696, CA099319, CA204586, CA196716, CA199496, CA171670,
CA200284, CA234725, CA068506)

SEQ ID NO. 227: SCQSST1037B07.g
(CA261004, CA241250, CA183198, CA296123, CA067033, CA177822, CA241340, CA217804,
CA266141, CA126550, CA217886, CA183583, CA285691, CA266216)

SEQ ID NO. 228: SCSBSD1029F09.g
(CA281292, CA275363, CA285616, CA286914, CA273656, CA286500, CA296413, CA283987,
CA291253, CA274747)

Quantitative or Real-Time PCR (RT-PCR)

Any method to measure mRNA levels for the genes can be used. For this work, five micrograms of total RNA were treated with DNAse I (Amplification grade, Invitrogen) according to the manufacturer's instructions and an aliquot of 7.5 µl of the treated RNA was reverse-transcribed using the SuperScript First-Strand Synthesis System for RT-PCR (Invitrogen). The 20 µl reverse transcription reactions contained the RNA template, 2 µl 10×RT buffer, 0.5 mM each dATP, dGTP, dCTP and dTTP, 50 ng random hexamers, 0.25 µg oligo(dT), 5 mM MgCl$_2$, 10 mM DTT (dithiothreitol), 40 U Rnase OUT and 50 U SuperScript II Reverse Transcriptase. RNA, random hexamers, dNTPs, and oligo(dT) were mixed first, incubated at 70° C. for 5 min and placed on ice. Subsequently, the remaining components, except the SuperScript II Reverse Transcriptase, were added to the reaction and the mixture was heated to 25° C. for 10 min and then incubated at 42° C. for 2 min. The SuperScript II Reverse Transcriptase was added to each tube and the reaction was incubated at 42° C. for 1.5 h, 72° C. for 10 min, and chilled on ice. An identical reaction without the reverse transcriptase was performed as a control, to confirm the absence of genomic DNA. The cDNA product was treated with 2 U of RNAseH (Invitrogen) for 30 min at 37° C. and for 10 min at 72° C. Real-time PCR reactions were performed using SYBR Green PCR Master Mix (Applied Biosystems) in a GeneAmp 5700 Sequence Detection System (Applied Biosystems). Primers were designed using the Primer Express 2.0 Software (Applied Biosystems). BLAST searches against the SUCEST database were conducted to ensure the specificity of the selected primers. The primer sequences designed are listed in Table XII. Each reaction was performed in duplicates and contained 2 µl of a 1:10 dilution of the synthesized cDNA, primers to a final concentration of 600 nM each, 12.5 µl of the SYBR Green PCR Master Mix and PCR-grade water to a total volume of 25 µl. The parameters for the PCR reaction were 50° C. for 2 min, 95° C. for 10 min, 40 cycles of 95° C. for 15 s and 60° C. for 1 min. The specificity of the amplified products was evaluated by the analysis of the dissociation curves generated by the equipment. Negative controls were also prepared in order to confirm the absence of any contamination. The ratio between the relative amounts of the target gene and the endogenous control gene in the RT-PCR reactions was determined based on the $2^{-\Delta\Delta Ct}$ method[18] with modifications. The normalized expression level was calculated as $L=2^{-\Delta Ct}$ and $\Delta C_T = C_{T, target} - C_{T, reference}$, for each sample. A polyubiquitin gene (SCCCST2001G02.g) and a GAPDH gene (SCQGAM2027G09.g) was used as an endogenous reference in the RT-PCR reactions after verification that its mRNA levels were similar in the populations and individuals tissues (not shown).

TABLE XII

Oligonucleotide sequences used in real-time PCR reactions.
Primers were designed using the Primer Express 2.0 Software (Applied Biosystems) and BLAST searches were conducted to ensure the specificity of the selected primers. The polyubiquitin gene (SCCCST2001G02.g) or the GAPDH gene (SCQGAM2027G09.g) were used as the endogenous reference in the RT-PCR reactions.

| SAS | Category | Subcategory | Oligonucleotide sequences | |
|---|---|---|---|---|
| SCEQRT1024E12.g | Hormone biosynthesis | Salicylic Acid | CTTCCAGGGCACTCCCATT (SEQ ID No. 381) | GAGAACTGCGCGAACATGAG (SEQ ID No. 396) |
| SCRFLR1012F12.g | Others | Caffeic acid 3-O-methyltransferase | CGGGTTCAAGGCCACCTA (SEQ ID No. 382) | AGGTGTGCGTATTTACTTGATGAACT (SEQ ID No. 397) |
| SCEQRT1028C03.g | Pathogenicity | R-genes transduction - PR protein | GAAATCGAGCCTCTCCTTCGT (SEQ ID No. 383) | GCAGCATCAGGCAGTTCAAC (SEQ ID No. 398) |
| SCAGLR1043E04.g | Stress | Cytochrome P450 - CYP74A | TGAAGCGGACGAATTTGAGTAG (SEQ ID No. 384) | AGCTCGCCATAGAGACTTGGAT (SEQ ID No. 399) |
| SCEQRT1026H08.g | Stress | Cytochrome P450 - CYP75 | GAACACCAGGTCCTGGTAGTTGT (SEQ ID No. 385) | AGCAACCGCCCTCCAAA (SEQ ID No. 400) |
| SCACCL6008H06.g | Stress | Low temperature induced (LTI) | AATCCCATCCATCCAAGCTAAG (SEQ ID No. 386) | CGGCGGCCGATCCT (SEQ ID No. 401) |
| SCCCRZ1002E08.g | Stress | Putative aquaporin (TIP) | AGGCATTGGAAACAACCATGA (SEQ ID No. 387) | GCTTTCAGATGCCGATTCAAG (SEQ ID No. 402) |
| SCJLRT1016G06.g | Stress | Ribonuclease | TACTACACGCTGAGCCAGATCAA (SEQ ID No. 388) | CACTCCACGTAGGGCTCGAA (SEQ ID No. 403) |
| SCCCLR2003E10.g | Transcription | NAM - NAC | CATCTTCTCCCACTCGTTCTTCTT (SEQ ID No. 389) | AGGGATCGCTCAGCTGGAT (SEQ ID No. 404) |
| SCCCST2001G02.g | Ubiquitination | Polyubiquitin | CCGGTCCTTTAAACCAACTCAGT (SEQ ID No. 390) | CCCTCTGGTGTACCTCCATTTG (SEQ ID No. 405) |
| SCEQLB2019B08.g | Protein Kinase | CIPK-8 | TCCGCATATACGAGGTGATG (SEQ ID No. 391) | AAAGAGCTCGCCACCAGTAG (SEQ ID No. 406) |
| SCSGHR1070F12.g | Protein Kinase | CIPK-29 | GGAAATCTCGACGATGAAGTTGA (SEQ ID No. 392) | TTGTTTACTTCCCATCACCTCGTA (SEQ ID No. 407) |
| SCCCCL5001D11.g | Protein Kinase | CIPK-1 | GGACCTCTGGTGCAACGTAGTT (SEQ ID No. 393) | CGCTATCTCAGCAAATCAAGGA (SEQ ID No. 408) |
| SCQGAM2027G09.g | GAPDH* | COMT | CACGGCCACTGGAAGCA (SEQ ID No. 394) | TCCTCAGGGTTCCTGATGCC (SEQ ID No. 409) |
| SCRFLR1012F12.g | Others | | CGGGTTCAAGGCCACCTA (SEQ ID No. 395) | AGGTGTGCGTATTTACTTGATGAACT (SEQ ID No. 410) |

*The GAPDH primer sequences were retrieved from Iskandar et al., (2004).

Northern Blot

Electrophoresis of total RNA samples (10 μg) can be carried out on 1.5% formaldehyde-containing agarose gels by standard procedures (Sambrook et al., 1989) and transferred to nylon filter (Hybond-N+, Amershan Biosciences). For this work, for each gene tested, the longest EST clone of each SUCEST SAS was selected as probe for RNA blot hybridization. Inserts were labeled with the Read-To-Go kit (Amershan Biosciences) according to the protocol recommended by the manufacturer. Hybridized filters were exposed to imaging plates for 24 h and the digitized images of RNA blot hybridization signals were detected with the FLA3000-G screen system (Fuji Photo Film, Japan) and quantified with the Image Gauge software v. 3.12 (Fuji Photo Film, Japan).

Methods for Detecting Protein Expression Levels

To measure or evaluate the proteins encoded by polynucleotide SEQ ID NO. 1-203 or SEQ ID Nos. 229 to 373 a number of well established techniques can be used (Cell Biology—A Laboratory Handbook, Academic Press). Antibodies can be raised against a purified recombinant protein expressed, for example in bacterial strains, after the coding sequence is cloned in a bacterial expression vector such as the pET vector series from Invitrogen. Plant tissue samples can be collected, protein extracts can be prepared and separated by gel electrophoresis or applied in multi-well plates, and protein levels can be measured by western blot or ELISA (enzyme-linked immunosorbent assay) using the antibody and a secondary antibody conjugated to horseradish peroxidase, alkaline phosphatase or fluoresceine isothiocyanate. Alternatively, whole proteome analysis can analyze the proteins encoded by SEQ ID NO. 1-203 or SEQ ID Nos. 229 to 373 in large scale with the aid of mass-spectrometry technology (MALDI-TOF and related techniques) after protein separation. Techniques that can analyze (for a review see Newton at al., 2004) and evaluate protein levels in large scale have also been described (Kirpatrick et al., 2005).

Transgenic Plants of this Invention

Transgenic plants can be generated using SEQ ID NO. 1 to 203 or SEQ ID Nos. 229 to 373. Alternatively, transgenic plants can be generated by a variety of techniques using additional genes and characterized using SEQ ID NO.1 to 203 or SEQ ID Nos. 229 to 373. Techniques for transforming a wide variety of higher plant species are well known and described (Weising et al., 1988). A DNA sequence coding for the desired polypeptide, for example a cDNA sequence encoding a full length protein, will preferably be combined with transcriptional and translational initiation regulatory sequences which will direct the transcription of the sequence from the gene in the intended tissues of the transformed plant. For example, for overexpression, a plant promoter fragment may be employed which will direct expression of the gene in all tissues of a regenerated plant.

Such promoters are referred to herein as "constitutive" promoters and are active under most environmental conditions and states of development or cell differentiation. Examples of constitutive promoters include the cauliflower mosaic virus (CaMV) 35S transcription initiation region, the 1'- or 2'-promoter derived from T-DNA of *Agrobacterium tumafaciens*, the maize ubi1 promoter derived from the ubiquitin gene, and other transcription initiation regions from various plant genes known to those of skill in the art.

Genes can be introduced into plants in expression cassettes that will increase the expression of the genes or silence the genes by anti-sense expression or RNA interference and lead to a higher sucrose content plant according to the methods described in this work.

Methods for Generating Plants with Increased Sugar Content

In certain embodiments, this invention provides methods for generating plants with increased sugar content by either increasing the expression of or interfering with the expression of or decreasing the expression of the polynucleotides of this invention. In some embodiments, the plant is transgenic and generated by expression of a gene expressing or interfering with the expression of a polynucleotide or polypeptide of this invention. Transgenic plants can be generated using SEQ ID NO. 1 to 203 or SEQ ID Nos. 229 to 373. In other embodiments, the plant is one generated by standard breeding techniques or mutagenesis.

Preparation of Recombinant Vectors for Plant Transformation

SEQ ID NO. 1-203 or SEQ ID Nos 229 to 373 can be used to generate transgenic plants with higher sucrose content. For this, recombinant DNA vectors suitable for transformation of plant cells are prepared. Transgenic plants can be obtained that express a recombinant expression cassette containing a promoter linked to one of polynucleotides 1 to 203 or SEQ ID NO. 229 to 373 that causes an increase in sucrose content in the transgenic plant when compared to control untransformed plants or plants transformed with vector alone.

Depending on whether increased sugar content is correlated with increased or decreased expression of a particular polynucleotide, DNA constructs can be designed to either increase or interfere with/decrease the expression of specific genes.

Gene expression can be increased using recombinant DNA constructs with a polynucleotide of interest in the sense orientation relative to the promoter to achieve gene overexpression.

Gene expression can be decreased using recombinant DNA constructs with a polynucleotide of interest in the antisense orientation relative to the promoter to achieve gene silencing. For example, a fragment of a gene of interest can be cloned in the pAHC17 vector (Christensen and Quail, 1996). Transgenic plants obtained through this method include sugarcane transgenic plants T1a, T1f, T2a, T2c and T3d originated from cultivar SP83-2847. Embryogenic calli originated from this cultivar were transformed by biolistic as described below with the COMT-AS/pAHC17 construct containing a 535 bp fragment of SEQ NO. 161 cloned into the BamHI site for the antisense orientation. Plants were co-transformed with pHA9 vector (Wei and Albert, U.S. Pat. No. 6,706,948).

Gene expression can be decreased or interfered with by suppressing transcription of a gene or the accumulation of the mRNA corresponding to that gene thereby preventing translation of the transcript into protein. Posttranscriptional gene suppression is mediated by transcription of integrated recombinant DNA to form double-stranded RNA (dsRNA) having homology to a gene targeted for suppression. This formation of dsRNA most commonly results from transcription of an integrated inverted repeat of the target gene, and is a common feature of gene suppression methods known as anti-sense suppression, co-suppression and RNA interference (RNAi). Transcriptional suppression can be mediated by a transcribed dsRNA having homology to a promoter DNA sequence to effect what is called promoter trans suppression.

More particularly, posttranscriptional gene suppression by inserting a recombinant DNA construct with anti-sense oriented DNA to regulate gene expression in plant cells is disclosed in U.S. Pat. No. 5,107,065 (Shewmaker et al.) and U.S. Pat. No. 5,759,829 (Shewmaker et al.). Transgenic plants transformed using such anti-sense oriented DNA constructs for gene suppression can comprise integrated DNA arranged as an inverted repeats that result from insertion of the DNA construct into plants by *Agrobacterium*-mediated transformation, as disclosed by Redenbaugh et al., in "Safety Assessment of Genetically Engineered Flavr Savr™ Tomato, CRC Press, Inc. (1992). Inverted repeat insertions can comprise a part or all of the T-DNA construct, e.g., an inverted repeat of a complete transcription unit or an inverted repeat of transcription terminator sequence. Screening for inserted DNA comprising inverted repeat elements can improve the efficiency of identifying transformation events effective for gene silencing whether the transformation construct is a simple anti-sense DNA construct which must be inserted in multiple copies or a complex inverted repeat DNA construct (e.g., an RNAi construct) which can be inserted as a single copy.

Posttranscriptional gene suppression by inserting a recombinant DNA construct with sense-oriented DNA to regulate gene expression in plants is disclosed in U.S. Pat. No. 5,283,184 (Jorgensen et al.) and U.S. Pat. No. 5,231,020 (Jorgensen et al.). Inserted T-DNA providing gene suppression in plants transformed with such sense constructs by *Agrobacterium* is organized predominately in inverted repeat structures, as disclosed by Jorgensen et al., Mol. Gen. Genet., 207:471-477 (1987). See also Stam et al. The Plant Journal, 12(1), 63-82 (1997) who used segregation studies to support Jorgensen's finding that gene silencing is mediated by multimeric transgene T-DNA loci in which the T-DNAs are arranged in inverted repeats. Screening for inserted DNA comprising inverted repeat elements can improve the gene silencing efficiency when transforming with simple sense-orientated DNA constructs. Gene silencing efficiency can also be improved by screening for single insertion events when transforming with an RNAi construct containing inverted repeat elements As disclosed by Redenbaugh et al., gene suppression can be achieved by inserting into a plant genome recombinant DNA that transcribes dsRNA. Such a DNA insert can be transcribed to an RNA element having the 3' region as a double stranded RNA. RNAi constructs are also disclosed in EP 0426195 A1 (Goldbach et al., 1991) where recombinant DNA constructs for transcription into hairpin dsRNA for providing transgenic plants with resistance to tobacco spotted wilt virus. Double-stranded RNAs were also disclosed in WO 94/01550 (Agrawal et al.) where anti-sense RNA was stabilized with a self-complementary 3' segment. Agrawal et al., referred to U.S. Pat. No. 5,107,065 for using such self-stabilized anti-sense RNAs for regulating gene expression in plant cells; see International Publication No. 94/01550. Other double-stranded hairpin-forming elements in transcribed RNA are disclosed in International Publication No. 98/05770 (Werner et al.) where the anti-sense RNA is stabilized by hairpin forming repeats of poly(CG) nucleotides. See also U.S. Patent Application Publication No. 2003/0175965 A1 (Lowe et al.) which discloses gene suppression using and RNAi construct comprising a gene, coding sequence preceded by inverted repeats of 5'UTR. See also U.S. Patent Application Publication No. 2002/0048814 A1 (Oeller) where RNAi constructs are transcribed to sense or anti-sense RNA which is stabilized by a poly(T)-poly(A) tail. See also U.S. Patent Application Publication No. 2003/0018993 A1 (Gutterson et al.) where sense or anti-sense RNA is stabilized by an inverted repeat of a of the 3' untranslated region of the NOS gene. See also U.S. Patent Application Publication No. 2003/0036197 A1 (Glassman et al.) where RNA having homology to a target is stabilized by two complementary RNA regions.

Gene silencing can also be effected by transcribing RNA from both a sense and an anti-sense oriented DNA, e.g., as disclosed by Shewmaker et al., in U.S. Pat. No. 5,107,065 where in Example 1a binary vector was prepared with both sense and anti-sense aroA genes. See also U.S. Pat. No. 6,326,193 where gene targeted DNA is operably linked to opposing promoters.

Gene silencing can also be affected by transcribing from contiguous sense and anti-sense DNA. In this regard see Sijen et al. The Plant Cell, Vol. 8, 2277-2294 (1996) discloses the use of constructs carrying inverted repeats of a cowpea mosaic virus gene in transgenic plants to mediate virus resistance. Such constructs for posttranscriptional gene suppression in plants by double-stranded RNA are also disclosed in International Publication No. WO 99/53050 (Waterhouse et al.), International Publication No. WO 99/49029 (Graham et al.), U.S. patent application Ser. No. 10/465,800 (Fillatti), U.S. Pat. No. 6,506,559 (Fire et al.). See also U.S. application Ser. No. 10/393,347 (Shewmaker et al.) that discloses constructs and methods for simultaneously expressing one or more recombinant genes while simultaneously suppressing one or more native genes in a transgenic plant. See also U.S. Pat. No. 6,448,473 (Mitsky et al.) that discloses multi-gene suppression vectors for use in plants. All of the above-described patents, applications and international publications disclosing materials and methods for posttranscriptional gene suppression in plants are incorporated herein by reference.

Transcriptional suppression such as promoter trans suppression can be affected by a expressing a DNA construct comprising a promoter operably linked to inverted repeats of promoter DNA for a target gene. Constructs useful for such gene suppression mediated by promoter trans suppression are disclosed by Mette et al. The EMBO Journal, Vol. 18, No. 1, pp. 241-148, 1999 and by Mette et al. The EMBO Journal, Vol. 19, No. 19, pp. 5194-5201-148, 2000, both of which are incorporated herein by reference.

Suppression can also be achieved by insertion mutations created by transposable elements may also prevent gene function. For example, in many dicot plants, transformation with the T-DNA of *Agrobacterium* may be readily achieved and large numbers of transformants can be rapidly obtained. Also, some species have lines with active transposable elements that can efficiently be used for the generation of large numbers of insertion mutations, while some other species lack such options. Mutant plants produced by *Agrobacterium* or transposon mutagenesis and having altered expression of a polypeptide of interest can be identified using the polynucleotides of the present invention. For example, a large population of mutated plants may be screened with polynucleotides encoding the polypeptide of interest to detect mutated plants having an insertion in the gene encoding the polypeptide of interest.

In some embodiments, DNA constructs can be the full length cDNA cloned in the expression vector pAHC17 (Christensen and Quail, 1996) in a sense orientation for overexpression or in an antisense orientation for gene silencing. Full length cDNAs can be amplified by PCR using specific primers and cloned into the BamHI site of the vector pAHC17 that will drive the constitutive expression of genes under the control of the maize ubi1 promoter (Christensen et al. 1992) and has been shown to be effective in the transformation and expression of genes in sugarcane. Other examples of constitutive promoters include the cauliflower mosaic virus (CaMV) 35S transcription initiation region, the 1'- or 2'-promoter derived from T-DNA of *Agrobacterium tumaefaciens*, the ubi4 and ubi9 promoters isolated from sugarcane polyubiquitin genes (Wei et al. 1999; Wei et al. 2003), the rice actin Act1 promoter (McElroy et al. 1990, McElroy et al. 1991), the pEmu promoter (Last et al. 1990, Chamberlain et al. 1994) and other transcription initiation regions from various plant genes known to those of skill.

Alternatively, expression vectors can be constructed using sugarcane promoters. Constitutive promoters and regulatory elements can be isolated from genes that are expressed constitutively or at least expressed in most if not all tissues of the plant. Such genes include, for example, the 153 genes described by Papini-Terzi et al., 2005 as ubiquitously expressed in sugarcane tissues.

Alternatively, the sugarcane promoter may direct expression of a nucleic acid of the invention in a specific tissue, organ or cell type (i.e. tissue-specific promoters) such as the 217 genes described by Papini-Terzi et al., 2005 as being preferentially expressed in roots, internodes, leaves, lateral buds or inflorescences of sugarcane. For antisense constructs full length cDNA or cDNA fragments of around (but not restricted to) 500 bp in length can be used. If a full length coding sequence is not available it can be cloned for instance by RACE (Frohman et al., 1988). For RNA interference (RNAi) the vector pKannibal and pHannibal (Wesley et al., 2001) can be used. Primers can be designed that specifically amplify around (but not restricted to) 200 to 400 bp of the target gene. Two PCR fragments will be produced with oligonucleotide primers planned to allow for cloning in the sense and antisense orientation and for a self complementary hairpin to be formed when expressed in the plant cell. The PCR fragments will contain restriction sites at their end that will allow for their introduction on the sites of XhoI/EcoRI/KpnI (sense) and ClaI/HindIII/XbaI/BamHI (antisense) in the pKannibal or pHannibal vector for instance. If proper polypeptide expression is desired, a polyadenylation region at the 3'-end of the coding region should be included. The polyadenylation region can be derived from the natural gene, from a variety of other plant genes, or from T-DNA. Transgenic plants obtained through this method include sugarcane transgenic plants 12SNF8b, 12SNF7c, 8SNF2a and 8SNF2b originated from cultivar SP94-3116. Embryogenic calli originated from this cultivar were transformed by biolistic as described below using a 331 bp fragment of SEQ NO. 106 cloned into the XhoI/EcoRI sites for the sense and HindIII/XbaI sites for the antisense orientations.

The expression vector comprising the sequences (e.g., promoters or coding regions) from genes of the invention will typically comprise a marker gene that confers a selectable phenotype on plant cells. For example, the marker may encode biocide resistance, particularly antibiotic resistance, such as resistance to kanamycin, G418, bleomycin, hygromycin, or herbicide resistance, such as resistance to chlorosulfuron or Basta.

Vector DNA preparation for transformation of sugarcane by bombardment uses a variation of the co-precipitation method of Klein et al. (1988a,b).

Plant Transformation and Propagation

Sugarcane transformation is as a well established technique (see Falco et al., 2000 for an example). Transgenic plants are recovered from embryogenic callus transformed using a modified biolistic protocol. Callus initiation and maintenance from sugarcane varieties is done on medium containing Murashige & Skoog salts, 3 mg/L 2,4-D, 5% coconut water, 150 mg/L citric acid, 250 mg/L Clavulin Beecham, and 7 g/L agar (CI-3 medium). Young leaf rolls of 6-12 month old plants are cultured for a month in the dark, at 27° C. and selected embryogenic callus is subcultured on the same medium every 3 weeks. Embriogenic calli can be bombarded with plasmid expression vectors containing one of the sequences 1 to 203 or SEQ ID Nos. 229 to 373. After bombardment, calli are kept in the dark for 1 week on $C_{1-3}$ medium, without selection, for recovery. Transgenic calli are selected on the same medium containing 35 mg/L of geneticin for 6 weeks. Resistant calli are placed on the same medium without 2,4-D to regenerate plants. After approximately 3 months, plants are transferred to soil and kept in the greenhouse, where they are tested for vector genomic insertion and expression. Non-transgenic control plants are obtained by regeneration from the same callus type going through the same tissue culture steps without bombardment and selection. Generally, embryogenic calli of the Brazilian sugarcane (*Saccharum officinarum* L.) genotype SP80-180, SP80-185, SP94-3116, CTC1, SP83-2847, SP80-1842, SP91-1049. (but not restricted to) can be co-transformed with the plasmid pHA9 containing genes coding for neomycin phosphotransferase (neo) and a plasmid containing the gene of interest (one of SEQ ID NO. 1 to 203 or SEQ ID NO. 229 to 373 in plasmid pAHC17, pKannibal or pHannibal, for instance), by particle bombardment. Transformed plants will be initially selected on culture medium containing Geneticin, and resistance can be confirmed by localized application of a kanamycin solution to leaves of hardened plants at the nursery if desired. Southern analysis can confirm stable integration of both target and neo genes. Alternatively, plants can be submitted to analysis by PCR to confirm the insertion of the expression constructs in the sugarcane genome. Oligonucleotide primers specific to the expression constructs will be used in amplification reactions using genomic DNA extracted from a sample of the transformed plants. Confirmed plants are then allowed to regenerate to 4 cm high plants and then allowed to grow in green houses when the expression levels of the target gene will be verified by real-time PCR. Also, brix measures will be taken to verify sucrose content. Alternatively, genes can be introduced into sugarcane or other plants using techniques such as electroporation or microinjection of plant cell protoplasts.

Plant regeneration from cultured protoplasts is described in Evans et al., Protoplasts Isolation and Culture, Handbook of Plant Cell Culture, pp. 124-176, MacMillilan Publishing Company, New York, 1983; and Binding, Regeneration of Plants, Plant Protoplasts, pp. 21-73, CRC Press, Boca Raton, 1985. Regeneration can also be obtained from plant callus, explants, organs, or parts thereof. Such regeneration techniques are described generally in Klee et al. Ann. Rev. of Plant Phys. 38:467-486 (1987). The introduction of DNA constructs using polyethylene glycol precipitation is described in Paszkowski et al. EMBO. J. 3:2717-2722 (1984). Electroporation techniques are described in Fromm et al. Proc. Natl. Acad. Sci. USA 82:5824 (1985). Additional details of ballistic transformation techniques are described in Klein et al. Nature 327:70-73 (1987). Transgenes can also be transferred to plant cells without the need of a vector DNA backbone, using linear transgene constructs (Fu et al., 2000, Loc et al., 2002).

Alternatively, the DNA constructs may be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria. *Agrobacterium tumefaciens*-mediated transformation techniques, including disarming and use of binary vectors, are well described in the scientific literature. See, for example Horsch et al. Science 233:496-498 (1984), and Fraley et al. Proc. Natl. Acad. Sci. USA 80:4803 (1983) and Gene Transfer to Plants, Potrykus, ed. (Springer-Verlag, Berlin 1995).

Alternatively, the DNA constructs may be combined with suitable T-DNA vectors, such as pCAMB1A vectors pC1105.1, pC1105.1r or modified versions of those, and introduced into alternative bacterial host vectors such as *Sinorhizobium meliloti, Rhizobium* sp. or *Mesorhizobium loti* (also known as Transbacter strains) as described (Broothaerts et al., 2005).

Sugar measurements can be done in six month old plants. Total and reductive sugars can be determined in leaves from control and transgenic plants collected, immediately frozen in liquid nitrogen and lyophilized. Twenty mg of the lyophilized material can be ground using a ball mill and subjected to extraction of soluble sugars with 1 mL of ethanol 80% for 20 minutes. This process is repeated six times (exhaustive extraction). The alcoholic extract is dried in a rotoevaporator and resuspended in 1 mL of milli-Q water. The levels of total and reductive sugars (Glc+Fru) are quantified by a colorimetric method using the phenol-sulphuric (Dubois et al., 1956) and the Somogy-Nelson (Somogy, 1945) procedures and glucose 1 mg/mL as standard. The sucrose content is estimated by subtracting the amount of reductive sugars from the amount of total sugars. Transgenic plants can also be characterized for brix content and considered to be improved for sucrose content if a brix difference of 3 degrees is observed. Differential expression of SEQ ID NO. 1-203 can be used in sucrose yield field-trials to select for the best events (transformants) or in a pre-test prior to field trials. Tissue samples can be obtained as described above.

Identification of Plants with Mutated Alleles

Variations in SEQ ID NO. 1-203 or SEQ ID NO. 229 to 373 locus can be generated by non-transgenic methods, can be found in progenies generated by traditional breeding, or can be found in naturally occurring genotypes.

The *Saccharum officinarum* and *Saccharum spontaneum* genotypes, the progenies of crosses between them and the crosses of commercial varieties described in this work can be screened for mutations in SEQ ID NO. 1-203 or SEQ ID NO. 229 to 373. Alternatively, sugarcane seeds can be mutagenized to increase the allelic variation for SEQ ID Nos. 1-203 or SEQ ID NO. 229 to 373. For example sugarcane can be chemically mutagenized with EMS (Ethylmethane sulfonate—EMS).

Mutations or natural variations in SEQ ID NO. 1-203 or SEQ ID NO. 229 to 373 can be identified by Tilling as was described for wheat (Slade et al., 2005). With Tilling a library of DNA samples from mutagenized or naturally occurring variants, or variants generated by traditional breeding can be identified. Mutations will be detected by amplifying regions of SEQ ID NO. 1-203 by Polymerase Chain Reaction (PCR). The PCR products will be heated and re-annealed to allow heteroduplexes to form between mutated and wild-type DNA. Heteroduplexes are identified through cleavage of mismatched sites by endonucleases such as Cell and cleaved products identified by gel-electrophoresis. The nature of the mutation will be identified by sequencing the PCR fragment.

Use as Molecular Markers: Generation of Molecular Markers Based on Restriction Fragment Length Polymorphisms SEQ ID NO. 1-203 can be used to detect differences between individuals at the DNA sequence level. Genomic DNAs from any number of individuals can be digested with a restriction enzyme, preferably a six-base pair cutting enzyme, electrophoresed and can be probed with any of the SEQ ID NO. 1-203 DNA clones, labelled with radioisotopes. Polymorphisms in the hybridization patterns can be due to differences in the gene sequences between the individuals. The term "restriction fragment length polymorphism" has been coined to describe this variation. For example, genomic DNA can be extracted from sugarcane individuals from any of the populations cited in this invention, digested with one restriction enzyme, such as (but not limited to) EcoRI, Hind III, DraI, BamHI. Restriction fragments can be separated on 0.8% (w/v) agarose gel, using TAE (40 mM Tris acetate, pH 8.0; 2 mM EDTA) as running buffer at 20 mA for 22 h and transferred to nylon membranes.

SEQ ID NO. 1-203 can be used to generated probes using $^{32}$PdCTP using any commercial kit, such as the Rediprime II kit from Amersham (USA). Hybridizations can be performed in a hybridization solution containing for example 0.5 M Na2PO4 pH 7.2, 1% BSA, 7% SDS, 100 µg/mL sheared herring sperm DNA), at 65° C. for up to 24 h. The membranes can be washed once during 20 min at 65° C. solution I (2×SSC; 5% SDS), then 20 min at 65° C. in solution II (1×SSC; 5% SDS 5%) and 20 min at 65° C. in solution III (0.5×SSC; 5% SDS).

Restriction fragment length polymorphism can be visualized by exposition to an imaging plate for 3-10 days at −80° C. and detected using a phosphorimager, such as the FLA3000 (Fuji, Japan). Those skilled in the art will easily use standard procedures to marker notation, analysis of each molecular marker segregation in the population individuals, and finally the linkage analysis to predict the usefulness of each of the SEQ ID Nos. 1-203 as molecular markers. An example of these steps has been described by Garcia et al., (2006).

Although the foregoing invention has been described in some detail by way of illustration and examples for purposes of clarity and understanding, it will be obvious that certain modifications and alternative embodiments of the invention are contemplated which do not depart from the spirit and scope of the invention as defined by the foregoing teachings and appended claims.

REFERENCES

Bachmann, M., Huber, J. L., Athwal, G. S., Wu, K., Ferl, R. J., and Huber, S. C. (1996). 14-3-3 proteins associate with the regulatory phosphorylation site of spinach leaf nitrate reductase in an isoform-specific manner and reduce dephosphorylation of Ser-543 by endogenous protein phosphatases. FEBS Letters 398, 26-30.

Becraft, P. W. (2002). Receptor Kinase Signaling in Plant Development. Annual Review of Cell and Developmental Biology 18, 163-192.

Berridge, M. J. (1993). Inositol Trisphosphate and Calcium Signaling. Nature 361, 315-325. Binding, Regeneration of Plants, Plant Protoplasts, pp. 21-73, CRC Press, Boca Raton, 1985.

Bornke, F. (2005). The variable C-terminus of 14-3-3 proteins mediates isoform-specific interaction with sucrose-phosphate synthase in the yeast two-hybrid system. J Plant Physiol. 162, 161-8.

Bowman, J. L., Smyth, D. R., Meyerowitz, E. M. (1989) Genes directing flower development in *Arabidopsis*. Plant Cell, 1(1), 37-52.

Broothaerts, W., Mitchell, H. J., Weir, B., Kaines, S., Smith, L. M. A, Yang, W., Mayer, J. E., Roa-Rodriguez, C. and Jefferson, R. A. (2005). Gene transfer to plants by diverse species of bacteria. Nature 433, 629-633.

Carraro, D. M., Lambais, M. R., Carrer, H. (2001). In silico characterization and expression analyses of sugarcane putative sucrose non-fermenting-1 (SNF1) related kinases. Genetics and Molecular Biology 24, 35-41.

Casu, R. E., Dimmock, C. M., Chapman, S. C., Grof, C. P. L., McIntyre, C. L., Bonnett, G. D. and Manners, J. M. (2004) Identification of differentially expressed transcripts from maturing stem of sugarcane by in silico analysis of stem expressed sequence tags and gene expression profiling. Plant Mol. Biol., 54, 503-517.

Chamberlain D A, Brettell R I S, Last D I, Wirtzens B, McElroy D, Dolferus R, Dennis E S (1994) The use of the Emu promoter with antibiotic and herbicide resistance genes for the selection of transgenic wheat callus and rice plants. Austr J Plant Physiol 21: 95-112

Chaumont, F., Moshelion, M., Daniels, M. J. (2005) Regulation of plant aquaporin activity. Biol Cell., 97(10), 749-64.

Christensen A. H., Quail P. H. (1996). Ubiquitin promoter-based vectors for high-level expression of selectable and/or screenable marker genes in monocotyledonous plants. Transgenic Research 5, 213-218.

Christensen A H, Sharrock R A, Quail P H (1992) Maize polyubiquitin genes: structure, thermal perturbation of expression and transcript splicing, and promoter activity following transfer to protoplasts by electroporation. Plant Mol Biol 18: 675-689

Comparot, S., Lingiah, G., Martin, T. (2003). Function and specificity of 14-3-3 proteins in the regulation of carbohydrate and nitrogen metabolism. J. Exp. Bot. 54, 595-604.

Cotelle, V., Meek, S. E. M., Provan, F., Milne, F. C., Morrice, N., MacKintosh, C. (2000). 14-3-3s regulate global cleavage of their diverse binding partners in sugar-starved *Arabidopsis* cells. EMBO J. 19, 2869-2876.

Dale, S., Arro, M., Becerra, B., Morrice, N. G., Boronat, A., Hardie, D. G., and Ferrer, A. (1995). Bacterial expression of the catalytic domain of 3-hydroxy-3-methylglutaryl-CoA reductase (isoform HMGR1) from *Arabidopsis thaliana*, and its inactivation by phosphorylation at Ser577 by *Brassica oleracea* 3-hydroxy-3-methylglutaryl-CoA reductase kinase. Eur J Biochem 233, 506-513.

Dodd, A. N., Salathia, N., Hall, A., Kevei, E., Toth, R., Nagy, F., Hibberd, J. M., Millar, A. J., and Webb, A. A. R. (2005). Plant circadian clocks increase photosynthesis, growth, survival, and competitive advantage. Science 309, 630-633.

DUBOIS, N.; GILLES, K. A.; HAMILTON, J. K.; REBERS, P. A.; SMITH, F. Colorimetric method for determination of sugars and related substances. Anal. Chem. Washington, v. 28, p. 350-356, 1956.

Evans et al., Protoplasts Isolation and Culture, Handbook of Plant Cell Culture, pp. 124-176, MacMillilan Publishing Company, New York, 1983

Falco M C, Neto A T, Ulian E C 2000 Transformation and expression of a gene for herbicide resistance in a Brazilian sugarcane Plant Cell Rep 19 (12):1188-1194

Felix, J. M. (2006). ANÁLISE DA EXPRESSÃO GÊNICA ENVOLVIDA NO METABOLISMO DE SACAROSE EM CANA-DE-AÇÚCAR (*Saccharum* spp.). PhD thesis defended Mar. 10, 2006. UNIVERSIDADE ESTADUAL DE CAMPINAS. CAMPINAS, São Paulo, Brasil.

Ferl, R. J. (2004). 14-3-3 proteins: regulation of signal-induced events. Physiol. Plantarum 120, 173-178.

Fraley R T, Rogers S G, Horsch R B, Sanders P R, Flick J S, Adams S P, Bittner M L, Brand L A, Fink C L, Fry J S, Galluppi G R, Goldberg S B, Hoffmann N L, Woo S C. (1983) Expression of bacterial genes in plant cells. Proc Natl Acad Sci USA. 80(15):4803-7.

Frohman M A, Dush M K, Martin G R (1988) Rapid production of full-length cDNA from rare transcripts: amplification using a single gene-specific oligonucleotide primer. Proc Natl Acad Sci USA 85(23):8998-9002

Fromm M, Taylor L P, Walbot V. (1985) Expression of genes transferred into monocot and dicot plant cells by electroporation. Proc Natl Acad Sci USA. 82(17):5824-8.

Halford N G, Paul, M J (2003). Carbon metabolite sensing and signalling. Plant Biotech. J. 1, 381-398.

Fu X D, Duc L T, Fontana S, Bong B B, Tinjuangjun P, Sudhakar D, Twyman R M, Christou P, Kohli A 2000. Linear transgene constructs lacking vector backbone sequences generate low-copy-number transgenic plants with simple integration patterns. Transgenic Res. 9:11-19.

Hanggi, E., Fleming, A. J. (2001) Sucrose synthase expression pattern in young maize leaves: implications for phloem transport. Planta, 214(2), 326-9.

Hardin, S. C., Huber, S. C. (1999) Proteasome activity and the post-translational control of sucrose synthase stability in maize leaves. Plant Physiol Biochem., 42(3), 197-208.

Hardin, S. C., Tang, G. Q., Scholz, A., Holtgraewe, D., Winter, H., Huber, S. C. (2003) Phosphorylation of sucrose synthase at serine 170: occurrence and possible role as a signal for proteolysis. Plant J., 35(5), 588-603.

Hardin, S. C., Winter, H., Huber, S. C. (2004) Phosphorylation of the amino terminus of maize sucrose synthase in relation to membrane association and enzyme activity. Plant Physiol. 134(4), 1427-38.

Ho, S. L., Chao, Y. C., Tong, W. F., Yu, S. M. (2001). Sugar coordinately and differentially regulates growth- and stress-related gene expression via a complex signal transduction network and multiple control mechanisms. Plant Physiol. 125, 877-890.

Horsch, R B, Fraley, R T, Rogers, S G, Sanders, P R, Lloyd, A, Hoffmann, N (1984) Inheritance of functional foreign genes in plants. Science 223:496-498.

Hrabak, E. M., Chan, C. W., Gribskov, M., Harper, J. F., Choi, J. H., Halford, N., Kudla, J., Luan, S., Nimmo, H. G., Sussman, M. R., Thomas, M., Walker-Simmons, K., Zhu, J. K., Harmon, A. C. (2000) The *Arabidopsis* CDPK-SnRK superfamily of protein kinases. Plant Physiol. 132(2), 666-80.

Huber, S. C., Huber, J. L., Liao, P. C., Gage, D. A., McMichael, R. W. Jr., Chourey, P. S., Hannah, L. C., Koch, K. (1996) Phosphorylation of serine-15 of maize leaf sucrose synthase. Occurrence in vivo and possible regulatory significance. Plant Physiol., 112(2), 793-802.

Huber, S. C. and Huber, J. L. (1996). Role and Regulation of Sucrose-Phosphate Synthase in Higher Plants. Annual Review of Plant Physiology and Plant Molecular Biology 47, 431-444.

Irish, V. F., Sussex, I. M. (1990) Function of the apetala-1 gene during *Arabidopsis* floral development. Plant Cell, 2(8), 741-53.

Iskandar, H. M., Simpson, R. S., Casu, R. E., Bonnett, G. D., MacLean, D. J. and Manners, J. M. 2004. Comparison of reference genes for quantitative real-time polymerase chain reaction. Plant Mol. Biol. Rep. 22, 325-337

Jacobsen, K. R., Fisher, D. G., Maretzki, A. and Moore, P. H. (1992). Developmental-changes in the ariatomy of the sugarcane stem in relation to phloem unloading and sucrose storage. Botanica Acta 105, 70-80.

Jansen, R. C. and Nap, J. P. (2001). Genetical genomics: the added value from segregation. Trends in Genetics 17, 388-391.

Jofuku, K. D., den Boer, B. G., Van Montagu, M., Okamuro, J. K. (1994) Control of *Arabidopsis* flower and seed development by the homeotic gene APETALA2. Plant Cell, 6(9), 1211-25.

Jones, T. L., Ort, D. R. (1997). Circadian regulation of sucrose phosphate synthase activity in tomato by protein phosphatase activity. Plant Physiol. 113, 1167-1175.

Kirkpatrick D S, Gerber S A, Gygi S P. (2005). The absolute quantification strategy: a general procedure for the quantification of proteins and post-translational modifications. Methods. 35(3):265-73.

Klee H. J., Horsch R. B., Rogers S. G. 1987 *Agrobacterium* mediated plant transformation and its further applications to plant biology. Ann. Rev. Plant Physiol. 38:467 486.

Klein T. M., Wolf E. D., Wu R., Sanford J. C. (1987) High velocity microprojectiles for delivering nucleic acids into living cells. Nature 327:70-73.

Klein, T. M., Fromm M., Weissinger A., Tomes, D., Schaff, S., Sletten, M., Sanford, J. C. (1988a). Transfer of foreign genes into intact maize cells with high-velocity microprojectiles. Proc. Natl. Acad. Sci. USA 85:4305-4309.

Klein, T. M. Gradziel, T. Fromm, M. E., Sanford, J. C. (1988b). Factors influencing gene delivery into *Zea mays* cells by high-velocity microprojectiles. Biotechnolology, 6:559-563.

Koch, K. E. (1996). Carbohydrate-Modulated Gene Expression in Plants. Ann. Rev. of Plant Physiol. Plant Mol. Biol. 47, 509-540.

Kolattukudy, P. E. (1984) Biochemistry and function of cutin and suberin. Can J Bot, 62, 2918-2933.

Kunst, L., Klenz, J. E., Martinez-Zapater, J., and Haughn, G. W. (1989) AP2 gene determines the identity of perianth organs in flowers of *Arabidopsis thaliana*. Plant Cell, 1, 1195-1208.

Last D, Brettell R, Chamberlain D, Chaudhury A, Larkin P, Marsh E, Peacock W, Dennis E (1991) pEmu: an improved promoter for gene expression in cereal cells. Theo Appl Genet. 81: 581-588.

Lee, E. J., Iai, H., Sano, H. and Koizumi, N. (2005) Sugar responsible and tissue specific expression of a gene encoding AtC1PK14, an *Arabidopsis* CBL-interacting protein kinase. Biosci. Biotechnol. Biochem., 69, 242-5.

Leon-Kloosterziel, K. M., Keijzer, C. J., Koornneef, M. (1994) A seed shape mutant of *Arabidopsis* that is affected in integument development. Plant Cell, 6(3), 385-392.

Lewis, N. G. and Yamamoto, E. (1990). Lignin: Occurrence, Biogenesis and Biodegradation. Annual Review of Plant Physiology and Plant Molecular Biology 41, 455-496.

Livak, K. J., Schmittgen, T. D. (2001) Analysis of relative gene expression data using real-time quantitative PCR and the 2(-Delta Delta C(T)) Method. Methods, 25(4), 402-8.

Loc N T, Tinjuangjun P, Gatehouse A M R, Christou P, Gatehouse J A. 2002. Linear transgene constructs lacking vector backbone sequences generate transgenic rice plants which accumulate higher levels of proteins conferring insect resistance. Mol. Breeding. 9:231-244.

Lumbreras, V., Alba, M. M., Kleinow, T., Koncz, C. and Pages, M. (2001). Domain fusion between SNF I-related kinase subunits during plant evolution. EMBO Rep. 2, 55-60.

Lunn, J. E. and Furbank, R. T. (1999). Sucrose biosynthesis in C-4 plants. New Phytologist 143, 221-237.

Ma H, Albert H, Paull R, Moore P (2000) Metabolic engineering of invertase activities in different subcellular compartments affects sucrose accumulation in sugarcane cells. Aust J Plant Physiol 27:1021-1030.

Ma S, Quist T M, Ulanov A, Joly R, Bohnert H J (2004) Loss of TIP1.1 aquaporin in *Arabidopsis* leads to cell and plant death. The Plant Journal 40(6):845-59.

Majerus, P. W., Kisseleva, M. V., and Norris, F. A. (1999). The role of phosphatases in inositol signaling reactions. J. Biol. Chem. 274, 10669-10672.

Mattfeldt, T., Trijic, D., Gottfried, H. W., Kestler, H. A. (2004). Classification of incidental carcinoma of the prostate using learning vector quantization and support vector machines. Cell Oncol. 26(1-2):45-55.

Maurel, C., Chrispeels, M. J. (2001) Aquaporins. A molecular entry into plant water relations. Plant Physiol., 125(1), 135-8.

McClung, C. R. (2001). Circadian Rhythms in Plants. Ann. Rev. Plant Physiol. Plant Mol. Biol. 52, 139-162.

McElroy D, Blowers A D, Jenes B, Wu R (1991) Construction of expression vectors based on the rice actin I (Act1) 5' region for use in monocot transformation. Mol Gen Genet. 231: 150-160.

McElroy D, Zhang W, Cao J, Wu R (1990) Isolation of an efficient actin promoter for use in rice transformation. Plant Cell 2: 163-171.

McMichael, R. W. Jr., Bachmann, M., Huber, S. C. (1995) Spinach feaf sucrose-phosphate synthase and nitrate reductase are phosphorylated/inactivated by multiple protein kinases in vitro. Plant Physiol., 108(3), 1077-1082.

McMichael, R. W., Klein, R. R., Salvucci, M. E., and Huber, S. C. (1993). Identification of the major regulatory phosphorylation site in sucrose-phosphate synthase. Arch. Biochem. Bioph. 307, 248-252.

Meireles S I, Cristo E B, Carvalho A F, Hirata R Jr, Pelosof A, Gomes L I, Martins W K, Begnami M D, Zitron C, Montagnini A L, Soares F A, Neves E J, Reis L F. (2004). Molecular classifiers for gastric cancer and nonmalignant diseases of the gastric mucosa. Cancer Res. 64(4):1255-65.

Meyers, B. C., Galbraith, D. W., Nelson, T., and Agrawal, V. (2004). Methods for Transcriptional Profiling in Plants. Be Fruitful and Replicate. Plant Physiol. 135, 637-652.

Modrusan, Z., Reiser, L., Feldmann, K. A., Fischer, R. L., Haughn, G. W. (1994) Homeotic Transformation of Ovules into Carpel-like Structures in *Arabidopsis*. Plant Cell, 6(3), 333-349.

Moore, P. H. (2005). Integration of sucrose accumulation processes across hierarchical scales: towards developing an understanding of the gene-to-crop continuum. Field Crops Research 92, 119-135.

Moorhead, G., Douglas, P., Cotelle, V., Harthill, J., Morrice, N., Meek, S., Deiting, U., Stitt, M., Scarabel, M., Aitken, A., and MacKintosh, C. (1999). Phosphorylation-dependent interactions between enzymes of plant metabolism and 14-3-3 proteins. The Plant Journal 18, 1-12.

Morsy, M. R., Almutairi, A. M., Gibbons, J., Yun, S. J., los Reyes, B. G. (2005). The OsLti6 genes encoding low-molecular-weight membrane proteins are differentially expressed in rice cultivars with contrasting sensitivity to low temperature. Gene 344, 171-180.

Murashige, T.; Skoog, F. 1962. A revised medium for rapid growth and bio-assays with tobacco tissue culture. Physiologia Plantarum, 15:473-497.

Newton M A, Noueiry A, Sarkar D, Ahlquist P. (2004) Detecting differential gene expression with a semiparametric hierarchical mixture method. Biostatistics 5, 155-76.

Nishiuchi, T. and Iba, K. (1998). Roles of plastid omega-3 fatty acid desaturases in defense response of higher plants. Journal of Plant Research 111, 481-486.

Nogueira, F. T. S., De Rosa, V. E., Menossi, M., Ulian, E. C., Arruda, P. (2003). RNA expression profiles and data mining of sugarcane response to low temperature. Plant Physiology 132, 1811-1824.

Ohto M A, Fischer R L, Goldberg R B, Nakamura K, Harada J J. (2005) Control of seed mass by APETALA2. Proc Natl Acad Sci U.S.A., 102, 3123-8.

Okamuro, J. K., den Boer, B. G., Jofuku, K. D. (1993) Regulation of *Arabidopsis* flower development. Plant Cell 5, 1183-93.

Pagnussat, G. C., Fiol, D. F., Salerno, G. L. (2002) A CDPK type protein kinase is involved in rice SPS light modulation. Physiol Plant., 115, 183-189.

Papini-Terzi, F. S., Rocha, F. R., Vencio, R. Z., Oliveira, K. C., Felix, J. M., Vicentini, R., Rocha, C. S., Simoes, A. C., Ulian, E. C., di Mauro, S. M., da Silva, A. M., Pereira, C. A., Menossi, M., Souza, G. M. (2005) Transcription profiling of signal transduction-related genes in sugarcane tissues. DNA Res., 12, 27-38.

Paszkowski J., Shillito R. D., Saul M., Mandak V., Hohn T., Hohn B., Potrykus I. (1984) Direct gene transfer to plants. EMBO J. 3:2717-2722

Pathre, U. V., Sinha, A. K., Shirke, P. A., and Ranade, S. A. (2004). Diurnal and seasonal modulation of sucrose phosphate synthase activity in leaves of *Prosopis juliflora*. Biol. Plant. 48, 227-235.

Perez, G., De Prata, F., Chinea, A., Bernal, N., O'Relly, J. P. (1997) Recursos genéticos de la caña de azúcar. Instituto Nacional de Investigaciones de La Caña de Azúcar (INICA), 249p.

Pessoa Junior, A., Roberto, I. C., Menossi, M., Santos, R. R., Ortega Filho, S., Penna, T. C. V. (2005). Perspectives on bioenergy and biotechnology in Brazil. Appl. Bioch. Biotech. 121, 59-70.

Potrykus, I. & Spangenberg, G. (1995). Gene transfer to plants. Springer-Verlag, Berlin.

Prescha, A., Swiedrych, A., Biemat, J., and Szopa, J. (2001). Increase in lipid content in potato tubers modified by 14-3-3 gene overexpression. J. Agric. Food Chem. 49, 3638-3643.

Riechmann, J. L., Meyerowitz, E. M. (1998) The AP2/EREBP family of plant transcription factors. Biol. Chem., 379(6), 633-46.

Roach, B. T., Daniels, J. (1987) A review of the origin and improvement of sugarcane. International Sugarcane Breeding Workshop, pp 1-33, COPERSUCAR, Sao Paulo, Brasil.

Rolland, F., Moore, B., Sheen, J. (2002). Sugar sensing and signaling in plants. Plant Cell 14, S185-S205.

Sambrook, J., Fritsch, E. F., Maniatis, T.; Hrsg. (1989). Molecular Cloning—A Laboratory Manual, 2nd Edition. Cold Spring Habour Laboratory Press, New York.

Sanders, D., Pelloux, J., Brownlee, C., Harper, J. F. (2002) Calcium at the crossroads of signaling. Plant Cell, 14, Suppl:S401-17.

Schuler, M. A., Werck-Reichhart, D. (2003) Functional genomics of P450s. Annu Rev Plant Biol., 54, 629-67.

Sehnke, P. C., DeLille, J. M., Ferl, R. J. (2002). Consummating signal transduction: The role of 14-3-3 proteins in the completion of signal-induced transitions in protein activity. Plant Cell 14, S339-S354.

Shi, J., Kim, K. N., Ritz, O., Albrecht, V., Gupta, R., Harter, K., Luan, S., Kudla, J. (1999) Novel protein kinases associated with calcineurin B-like calcium sensors in *Arabidopsis*. Plant Cell., 11(12), 2393-405.

Slade, A. J, Fuerstenberg, S. I., Loeffler, D., Steine, M. N., Facciotti, D. (2005). A reverse genetic, nontransgenic approach to wheat crop improvement by TILLING. Nat. Biotechnol. 23(1):75-81.

SOMOGY, M. A new reagent for determination of sugars. A new Sugar Reagent, May v. 16.0, p. 61-63, 1945.

Souza, G. M., Simoes, A. C. Q., Oliveira, K. C., Garay, H. M., Fiorini, L. C., Gomes, F. D., Nishiyama-Junior, M. Y., da Silva, A. M. (2001). The sugarcane signal transduction (SUCAST) catalogue: prospecting signal transduction in sugarcane. Genet. Mol. Biol. 24, 25-34.

Swiedrych, A., Prescha, A., Matysiak-Kata, I., Biernat, J., Szopa, J. (2002). Repression of the 14-3-3 Gene Affects the Amino Acid and Mineral Composition of Potato Tubers. J. Agric. Food Chem. 50, 2137-2141.

Thompson, J. D., Higgins, D. G. and Gibson, T. G. 1994. CLUSTAL W: improving the sensitivity of progressive multiple sequence alignment through sequence weighting, position-specific gap penalties and weight matrix choice. Nuclei Acids Research 22, 4673-4680.

Tibshirani R, Hastie T, Narasimhan B, Chu G. (2002) Diagnosis of multiple cancer types by shrunken centroids of gene expression. Proc Natl Acad Sci USA. 14; 99(10): 6567-72.

Toroser, D. and Huber, S. C. (1997). Protein phosphorylation as a mechanism for osmotic-stress activation of sucrose-phosphate synthase in spinach leaves. Plant Physiol. 114, 947-955.

Toroser, D., Athwal, G. S., Huber, S. C. (1998). Site-specific regulatory interaction between spinach leaf sucrose-phosphate synthase and 14-3-3 proteins. FEBS Letters 435, 110-114.

Vain P, De Buyser J, Bui Trang V, Haicour R, Henry Y. (1995) Foreign gene delivery into monocotyledonous species. Biotechnol Adv. 1995; 13(4):653-71.

Van Dillewijn C. (1952). Botany of sugarcane., Walthan Mass., ed. (EUA).

Vencio, R. Z. N., Koide, T. (2005) HTself: self-self based statistical test for low replication microarray studies. DNA Res., 12, 211-214.

Vettore, A. L., da Silva, F. R., Kemper, E. L., Souza, G. M., da Silva, A. M., Ferro, M. I., Henrique-Silva, F., Giglioti, E. A., Lemos, M. V. F., Coutinho, L. L., Nobrega, M. P., Carrer, H., Franca, S. C., Bacci, M., Jr., Goldman, M. H., Gomes, S. L., Nunes, L. R., Camargo, L. E. A., Siqueira, W. J., Van Sluys, M. A., Thiemann, O. H., Kuramae, E. E., Santelli, R. V., Marino, C. L., Targon, M. L. P. N., Ferro, J. A., Silveira, H. C. S., Marini, D. C., Lemos, E. G. M., Monteiro-Vitorello, C. B., Tambor, J. H. M., Carraro, D. M., Roberto, P. G., Martins, V. G., Goldman, G. H., de Oliveira, R. C., Truffi, D., Colombo, C. A., Rossi, M., de Araujo, P. G., Sculaccio, S. A., Angella, A., Lima, M. M. A., de Rosa, V. E. J., Siviero, F., Coscrato, V. E., Machado, M. A., Grivet, L., Di Mauro, S. M. Z., Nobrega, F. G., Menck, C. F. M., Braga, M. D. V., Telles, G. P., Cara, F. A. A., Pedrosa, G., Meidanis, J., Arruda, P. (2003). Analysis and Functional Annotation of an Expressed Sequence Tag Collection for Tropical Crop Sugarcane. Genome Res. 13, 2725-2735.

Wei H, Albert H H, Moore P H (1999) Differential expression of sugarcane polyubiquitin genes and isolation of promoters from two highly-expressed members of the gene family. J Plant Physiol 155, 513-519.

Wei H, Wang M L, Moore P H, Albert H H. (2003)Comparative expression analysis of two sugarcane polyubiquitin promoters and flanking sequences in transgenic plants. J Plant Physiol. 160(10):1241-51.

Weising K, Schell J, Kahl G. (1988) Foreign genes in plants: transfer, structure, expression, and applications. Annu Rev Genet. 1988; 22:421-77.

Wesley, S. V., Helliwell, C. A., Smith, N. A., Wang, M. B., Rouse, D. T., Liu, Q., Gooding, P. S., Singh, S. P., Abbott, D., Stoutjesdijk, P. A., Robinson, S. P., Gleave, A. P., Green, A. G., Waterhouse, P. M. (2001) Construct design for efficient, effective and high-throughput gene silencing in plants. Plant J. 27: 581-590.

Yang, Y. H., Dudoit, S., Luu, P., Lin, D. M., Peng, V., Ngai, J., Speed, T. P. (2002). Normalization for cDNA microarray data: a robust composite method addressing single and multiple slide systematic variation. Nucleic Acids Res 30:e15

Yu, S. M. (1999). Cellular and genetic responses of plants to sugar starvation. Plant Physiol. 121, 687-693.

Zhang, X. Q., Lund, A. A., Sarath, G., Cerny, R. L., Roberts, D. M., Chollet, R. (1999) Soybean nodule sucrose synthase (nodulin-100): further analysis of its phosphorylation using recombinant and authentic root-nodule enzymes. Arch Biochem Biophys., 371(1), 70-82.

Zrenner, R., Salanoubat, M., Willmitzer, L., Sonnewald, U. (1995) Evidence of the crucial role of sucrose synthase for sink strength using transgenic potato plants (*Solanum tuberosum* L.). Plant J., 7(1), 97-107.

Zuk, M., Skala, J., Biemat, J., Szopa, J. (2003). Repression of six 14-3-3 protein isoforms resulting in the activation of nitrate and carbon fixation key enzymes from transgenic potato plants. Plant Sci. 165, 731-741.

All references cited herein are incorporated by reference.

SEQUENCE LISTING (413 sequences)

SEQ ID NO: 1 - DNA, 684 bp, Saccharum
cccacgcgtccgcccacgcgtccgtttcaaactgctctcctctctctcgtctgtacgaccggcgacgttctctctctcctttctcattttatcagcacatcggctcgttccccggcggcatcgtccatccccaccggcggtggcggttccttctcccccgaccaacgtcgagggcgctcccttcagccatcggccggtggcggcacatcattagcacgggcggcagttttgtgcagcgggggcagcttcctctccagcagctgcggtgcaggggcatgggccaaacgatggggctccttttgctccagcaccctcggcgcccccggacggtgggcgcgccctcgttctccaacctagtcgtgctctccaactgcctgctcgtcgccatcgtgctcgccttcaccatcacgcagtccatcaaggtgctcaccacctggtatgccctcctcccctttcctccacgcgggctcggccggcgcccggatctgagctctccccctctctgacgcgaagcagctggtgggctccggcaggatgccatcctcgcactcacccactgtcacctcagtgtacgtgctctgttcttttctatgatttttgggaggattttctcaggtttgtatcgggggcaggtgatggaagtggagaaaaacaagaacttgcaggggagcatcgattctattc

SEQ ID NO: 2 - DNA, 1660 bp, Saccharum
aatcgcacaaggtcaagtactaatttgacaacaacaaaacatcccaaacatcacacatgcattagattgaaactaccaatctagttaatctccaacatcacacactacactaaccaactaattttacgtacatcggtacatgatgatacgcacttactatacatacacttccctcctaggaaaggattctgatcctgctcgatcgcatttcctcttgctagcgaatcaaccttcttcgcacacgtgccatgctgttaccacgtcgcccagctccacccggagctcctcccacccgaacgcctcggcctcgtcgccgtcgccgccctccagcctcagctccactagcatcagctcgtgcgacacctccgacatctccatcgacatggccacgagacccgacaggccgccgagcggcaggcgctcgactcccttcttccccaccatgaagtagccgagcttggcgccagcctgcccgagccgctccaccgtctgctcgggcgacgccgtggtcatgaaccgcttctcgcggcagctcctgctctggccgaacagccccgacaggtcgagcccgggggacatggagatgatgtcgaaggcgttcagcgccggcggggcctggaacgccagctcgcgctccgcctggccgcccagcaggcccccgagctgggagtccacgctgagcgagcgcttgaaccaggggtggctcgcgagctccgcgacggcgaggcgcgtcgccgggttcgggtccagcaggcgggccacgaggcggcgcgccggctgcgatacccaccgtggcaccgtgtactcccggcggtgcgccttgcggcacatgtcggcgatgttggcgtcgtcgaaagggaggtggcccgcgaggaggacgaagaggatgacgccacaggaccacgcgtcggccttggcaccgtcgtaggccttgcggcggagcacctcgggcgccgcgaacgccggggtgccgcacgccgtgtgcaggtggccgtcgtcgcggagcgagtccgggagcgcggcgagcccgaagtcggacaccttgaggttgccgtcggcgtccacgagcacgttctgcggcttcacgtcgcggtggaacaccccgcgcgcgtggctgtagatgagcgccgacgccagctgcaggaacacgcaccgcgcggcgtgctcggggagcctccgcgacggcagggaggcgagccgggacaggaggtccccgcccggggccagctccatcacgaggtacaccttggaccgcgtggccagcacctcgtggaggcggagcacgttggggtggctcaggcgccgcatggcggagacctcgcgcaggagccgcgacgccatgcccgcggcggccagctcgggcttgtcgagcaccttcacggccacggggtcgcccccggcgaggcagcgcgcgtggtataccttggcgaagttgcctcgaccgaggaggtggccgagctcatacttgccgaggagcggcgagccggccttggtggacgacttgctcttggtgccggccatggcgcgcggcaccaaggcgacgggcagggcaagccgcctctttggcttggtggtttacaggggctgggcttggtggtgccaaggtatataaaaaaagggagtggttgagtcttgtacgttgtttgtgtatggcgctctt

SEQ ID NO: 3 - DNA, 1400 bp, Saccharum
ctctctctccacatctctgtctcacctcccgataagagagggccctcggcttcccctccctcccctcctgcgctccagctcccctccatcctcggccaaaaatctgcggcgagctctgatccgatccgactactccccacgccgcagaagccgcgcgagctgatcgcgcgggggtcgaggagaggagaggacaggcgctgcggctgccaccgtaccgccgcaggaggagagaggagaaggaagaggagccgtacccgtccgcccgctccgctcccgccggaccgatcgaccgatggactcggagcactggatctcgcgcctggccgccgcgaagcgcttctacgcggcgcagctcggtcacagcgatcggacggggatggaggagctggacatggacgaggagctcaggcccgagttcgcctgcccctactgctacgaggaccacgacatcggatccctctgcgcgcacctcgaggaggagcacccgtacgagccccaagccgcggcttgccctgtttgctcagagatggttacgaaggatatggttaaccatattactatgcaacatggatatttattcaagaatcgtcgccggttgcgcagattcattattccaggcagccaggccctttctttactgagccgagatctacgggaagcccatttgcaggtgcttctaggaggcggacataggtcaagcaacaataacagcaccacaaatatttcagctgatcctcttctgtcatcattcggccttagcttccctacatcagatgcagagcaaacatccaaatcgactatttccattcctgatgatgctatgatggtaaaagaaacgcctgctcaggcacggaagctaagtatcgattcgtccctcacaagtgaagaaagggagcagaaacggaagcaagccagcgtcagagccacattcgtgcaagacctgctgctctctactctattcggggactaataaatcagggcgagcctaagttatcaccagaagggtgcttcccggtgcctgcaaagactagcgtgctccacccacccaacttgctgaattcctcgacggaacatacgcgcgcatccgggatgttagccttcgtcccctccagtaaggtgcagagttgatgtgggcatgtccaagttattgtaagccggtctctatcttcagttccttcacaactgacgatcagcatgtggtatgcatgcatgtcgcggttgtgcgtgtacctcgtctgtgtctgaactctgaagcattggtttgttgtaccaacataataataatgttgcaacagcggatggctatgcatacactgcagtgtgtaggagcaattaaacgagttccgaaactacatcgcatggctatacattgcactatttagggagtaatatgagtttcg

SEQ ID NO: 4 - DNA, 1181 bp, Saccharum
ccctcctctcactagtccctcctctcccaggtcacccagagagagctagcgaggtggtgagtgagaccagaccagcgcccacagggccggaccagcgctagccagccagctgattgcgccgcgcactagctacctctcggccggatcgctgctgggcgtctattaagccgccgacgccgtcgtccgccctcggcatgcgcggttctgctcgcccgggagatggcacctgcagcttcgatccactcggccaccgccgccgctgctggtgcttccaagcgcccggccgattccgacgctgagctcccgctcgactcctccgcgctccaccagcaggacgacgaggccgcgcgcaagggccagctccagcagccgaggcaacagcagcagctggagtgcccgcgctgtcgctctaccaacaccaagttctgctactacaacaactacagcacggcgcagccgcggcatttctgccgcgcgtgccgccgctactggacgcacggcggcacgctgcgcgacgtccccgtcggcggcgcctcgcgccgcgccggcgggggcggcaagcggcgcagggtctccgccgagccctcgtccgcggcgtcggcgtcgccgccgccgatgccggcagcgtcactcgcggacgcgtgcctgccggacctctcgtccgccttcccgttcctcagcgatggcagcttcttcccgcagttcgacgtcggcagcggtgttgcacttgcaccggcggccttttcctcctcgtggcagtcggtggtcccggatttttacgacgggctcgcgccgtgggacgacggagcgggcttcgcgggcgcttggggcgacatcgccggcctcgacctcagctggactccgccggggaactgagtacgtgccagccggtcgccgtcttgaggggctccggttttagcagtgcggcctcatcaggttcaggtagtgcttcgttccaagttcctagcatgcagtgtgtcccgttttgatgagctatccagctaggaacgtgagcagctcaaaattcttctatgccttcactgtttcttctcgtccttactacaaaatgaaatggtggctgctagttggatcagtcaaccttgatctgtagctgactagctggagcgaggatgtaagatatgtgcagtgatttatcatgacaataaaattaagtttgtgtc

SEQ ID NO: 5 - DNA, 1645 bp, Saccharum
gcccgtccgaaatatcgccccgcgattccctgcctcgccgactggctggctccccctccacctcgccgccgggcagcggagacccctccgggccgggatcgggttcctccttccccgccaacacgtatcagcgatgacgatctgccgctgaagcttgctcaagctccaataaagcatgacggttgtgcacataatgatgcttaatcattcatgctgctataccctcgagtggaacttccttcttctgatgcaaccgtatataggtggacctagttttgaggtggctgcgatgagttttgaaggcggcgagggatctttgcggcggagttctatttgttctcagtgattcttggaaaacgctctttggttaagttaataatcatggaaaggtacaaactgttacgggagataggtgatggaacctgtgggaatgtttttatggcttataatgtagaaactaatgaaattgttgctgttaaaaaaatgaagagaaagtttttccaatgggaagaatgcgttagtcttcgagaagtgaaggctcttcagaaactaattcaccctaacattgtgaagctgaaggaggtgacgatggaaaatcatgagctgttcttcatctttgaacacatggagtgtaatttatatgatgtcataagggaaaggcaagttcctttccctgaaggggatatacggaactttatggtccaaatactgcaaggtcttgcatatatgcataataacgggtatttccaccgtgatttgaaacctgagaatttgttggtgacaaatggtattgttaaaattgctgactttgggttggctagagaagtatcttccaatcctccttacactgattatgtttccaccagatggtaccgggctccagaggttctactgcaatcttcagcttatacacctgctattgacatgtgggcggttggtgctattttggctgagctttttacactgtcccctctttttcctggtgaaagtgagacagatcagctttacaaaatatgcactgtgcttgggagcccagattgcactatctggccagagggaatgaacctgcctcgttcatgtagctttaagttttttcagattcctccaagaaacttatgggagcttattcctaatgcttccttggaagcaattgacttgatccagcaactttgttcctgggatccacgaaggaggccaactgctgagcaagcattacaacatcccttctttaatgtgtgcaactgggtaccaagacctgtccatgatgcttcccatgcaaaaacagaagaacctaaagcgcatccaagattggaactgaacctgtgggatttcagcacagaacctgatgattgtttccttgatttaactctcaggattttctggctctccgttcggcctgacgttgcagccgaacctgttggagaaccattcgctagcaccaatccggcaggtgaatttcttctgacggagacaggattaacagattgagcattcatacgattcttgcgttcttcttgatacgtccagcttctcgctgtatacacactagcttgactcgaataagtggcggcaggcagtagaggaaatgtatatacagttcgtagctcttgatctttttctttttcttcaccaccacctttttttt

SEQ ID NO: 6 - DNA, 650 bp, Saccharum
ctcctcccgacacacctctttaactcgcctccgcttccaaaaaatgctccagttaatttaatccagacgaggaatcgcctcgccccgccccgccccgccccggatctctcgcccgcgaatccccaggcccgctcgctcgccgacaggaccgcgcgatcggctccggcgggaggtggttgactcgcactgcggcggggcgcgtcgccgccgccgcagctcggcacgggggctcgtcgggtcggcagtcgctttcgggtcgggcgctgtcgaggccagtggtgccggggcaatgcggtcagttcgtggagctgtttgaggcgcttgggctgggatctgagtgagggtgccaggtagtaggggaagcgagcgagcttctgtcggtggggagttggtggtggttgcagcagcgtagggcgcgcgtttggctgccgggatggagcacgtagtcgggggcaagttcaagcttgggaagaagatcgggagcggatcctttggggagctctacctcgccgtgaacgtgcagaatggcgaggaggtggctgtcaaactggaatcggtcaaatcacgacatccacagcttcactatgaatcaaaactatacatgctcttgcagggtggaactgggattccacatcttaagtggttcgggg

SEQ ID NO: 7 - DNA, 1302 bp, Saccharum
atgctcaactgtgtgagggcaagcctaccagatggcaacagtggaagtagggttgtgctcgtattggacatcgagaatgaagaagtagcatggcacgctaatggcatgaacaagggcatcagcgacggaatccgccacttgagccgtttggataaagaaaagagtgtgaagttgttctgttcgagggccgtcaggacaaatctatcagacgaaactacgggaaacagcatgatgagcatgtacagagaagttgtgtacaatataacttggggctaccctctggctatagtggttttggccggactactacgattcaaggagaagccagggcaatggacggcagtgctgcagcagctcaggtccggaccaccaatggaagaagcacatcagcaagacggcgaaggcaatcagataacaggacctgcaatgttccaggaggatcgtattgaggagaagatgagcccccctacaacagaagcagccaacctgtccacaagaacgtcgattgagagggtcttctgggcaagctttgaagaccttcccaatgacctcaagtcatgcttcctctacttggccgctttccccaaggacacctttctgtctaccaacagtatagtgcggatgtggatggccgagggattcatcaggccacagaagggcaagaccatcgaggagctgggtcacgactatttcaaagagctggccttgagatgccttgttcaggtttcagccatgaacgagtctggcggcattaagaaagtcatcgttcacaggaggctccatgggttcctgcattcagaggctcgtgaggcaggcttcattgacgcccacgacatgcatgacgtctttgttccaccatcggtgcgccgcctctctttcatgagttttcaaggtggatataccacgttcaccaacaagttctgtaagttgcgttccttcatatgctgggccaaggagaaagatcatcgtccaagcagcaatggtggtggcagcggaggtgtggacgaagagcattggcatgatctcaagtttctgcagggttcagatttacttcgtgtaatcgacgtacggggactaaggatcaaggagttgccgaatgagattggcgacaagatccacttgcggtaccttcgtgtaaacagcgagcacctcaaggagctcccgtccagcattcagaggctgctcaacctgcagacactggatataagggatactgaagtcgaggagattcacccgtccttctggaagataaagacgctgcggcatgtgattgcaaagaacctcacgcttccatcatccatc

SEQ ID NO: 8 - DNA, 857 bp, Saccharum
ccggctgccacggcgtgcgcggatggcaggaaccggtccatcatgacgctgcggtgggcgcacggccccgcccccgccccggcccccgcggcgtcgctgagcccggtcgcgctgcagttcacggtgacgcagctgacgtcgtcgcgggagagcgcgtccgagcaccgctcctcgccccgcggcgcgcgctcagaggccacggtcaccaccgccgccggattccgcgtcacgcgcgatggctcgtccacgtcgacgatcgtcgagggatgtggtggggccggcggcggcggccggcgggtacggacgctcttggggtgcccggggcggtgctcccacccgaatggcaccgcgctggtgtggcccggcggctccgacgtggcgtccgcctgcttgtatgccggcaaccccgtggccgcggtctcggcgccacctccaccgtggcgccggacggagaggagtggcgcggtgagattgatgcgcttgttggcgtcggccatgacgacggcctagttagacaactggtgagaatgcgaagctcgctgctgctccgcagaccgcaacaaccacttacttcgccactgcactgcactgcactaatgcacggattaaatagtgggagacgcttggatcgttctgcttaatgattccttgtactcgtattcaggtgcagcacagtagctcgccgcatggcgccggtatagccgtacacgacgtggcgagaagcgaccaaactgagctgacaggttgctacacagccactgcagtctgttgtctgtgcacgagctctgattccttaaaagtcctgaactctttcggctgatgattttttcggctgataagctgattgaaattgattt

SEQ ID NO: 9 - DNA, 1674 bp, Saccharum
atccccattccttccccagtcgccgcccgagtcaaaaagagggaagcttcttccaccacagtccttgaggccgccctcccatcaacgactagacgctagtcaagcagcagcacccaccctagcagccccacaaccctaggcccctctctcctccacacccccttcccgagaggcgaggaaggaaggagacgaagaaaccatggattcctcctccggcggcggcggagcgcagatcaagggtatggcgacgcacgggggccgctacgtgctgtacaacgtgtacggaaacctcttcgaggtctcctccaagtacgccccgcccatccgccccatcggccgcggcgcctacggcattgtctgcgcggctgtcaactcgcagacaggggaggaggttgcgatcaagaaggttggcaatgcgttcgacaaccacatcgacgccaagcggacgctgagggaaatcaagctgctgcgccacatggaccatgagaacatccttgccttaaggacgtataacgccccccaactagagagaactttaatgacgtgtacattgttactgagttaatggatacagatctccatcagatcatacgctcaaatcagccattgactgatgatcattgccagtactttttgtatcagttgctaagaggactaaagtatgtgcactcagcaaatatattgcaccgtgatctaaagccgagcaatttgttcctaaatgcaaattgtgacctcaagatcgcagactttgggcttgcaaggaccacctcagagacagatctcatgacggagtatgtggtcactcgttggtacagggcaccggagctgctgttgaactgttcacagtacactgccgccattgatgtctggtcagttggatgcatactaggtgaaatcgttactcgccaacccctgtttcctgggcgggattacatccagcaattaaaattgatcactgagctcataggctcaccagatgatgcaagcctgggattccttcgaagtgataatgcaaaaagatacatgaaacagctaccacagtttccaaagcaggacttccgcctgcgtttccgcaacatgtctcctggtgcagtcgatttgttggagagaatgcttgtgtttgatccaagcagacggattacagttgatgaggctttgcatcacccatacttggcttcacttcatgacatcaatgaagaacctacctgccctgcacctttcagctttgattttgagcaaccatcctttacagaagcgcatataaaagaacttatctggagggaatctttagcatttaacccggatcctccctactaatatcaaaaggataagttatctgctagaggcatatgaagatctctagctccagcggacgcaagaacttagtgtcagtgtgcatcgattatttgtgtgcggtttgttgggcaaacgggcatgggttgttgctgcaatagcaactctattagggcttgtgagagcaaacaaacgtctgtattccttttcagatgcctgaacccaggcttgtattataccgcttgatttcataaactattcttatgtatctaagcttgtaattttgtagacaattacttgaacgccccctgtatatctgagttgacatcacttccttattgtaacatctcaaacacattttattgtgattttaaaaaaaaa

SEQ ID NO: 10 - DNA, 805 bp, Saccharum
gacgacgccggcgcaggcgacctgccctaccgcaccgtgggatccaccgccgtggtcgccgtcgtgggccagcgccgcatcgtcgtcgccaactgcggcgactctcgcgccgtgctctcccgcggcggcgtcgccgtgccgctctccaccgatcacaagccggatcgtccggacgagatgcagagggtggaagcagccggcggcagagtcatcaactggaacggctaccgcgtcctgggagtcttggcgacttctaggtccattggcgactactacctgaagccgtacgtgagcgcggagccggaggtgacggtggtggaccggacggagcaggacgagtttctcatactggctagcgacgggctgtgggacgtggtctccaacgaggtggcgtgcaagatcgccaggaactgcctcagtgggcgggcggccttcaagttccccgagtccgtggccggccgaaccgccgcggacgccgccgcgctgctcacggaactggccatgtcccgcggcagcagggacaacatcagcgtcgtcgtggtcgagctgcagcggctcaagaggagccctgccgcggcctagatggtttagtttgctgagactgaactgagagcatgtagctgtagcgtgtagtagatgataacatttaaatatttgaagcgtgtgttgagaagctggggattacgagtctcccgctatcatcagggttcgaattgaacgggcatggtgatgcactatgtacataggagccttgtcgaatgtttgtttctcggtgttctaatcagtagcaatatgcaatttatat

SEQ ID NO: 11 - DNA, 478 bp, Saccharum
atcaatcccaatcccatccatccaagctaaggcaaggcagaggagaggcactgcacaggagaggaagaggatcggccgccggagtgcgatcaccgacaccaggcaggcagcagccatggcggaggggacggccaactgcgtggacatcctgatcgccatcatccttcccccgctgggggtgttcctcaagttcgggtgcgggcaccagttctggatctgcctcctcctcaccttcctcggctacctccccggcatcatctacgccgtctacgccatcaccaagtagctgtgcatttttatatgcctttgctacttgctcagctcgccgatatgtatgcatggatgccgatttcaataccttctagtagctaggtaccacatgctgctctgctcttctatgattctatctatgtgttcatatgtcgtgccgacttgtgtgtgatcgtcgatgaatcgaacaaccagttattaagctact

SEQ ID NO: 12 - DNA, 1721 bp, Saccharum
cgcggggcgtgtaccaccgcgatctcaagccggagaacctcctcatcgacttccccctcgccacgcaaagccaccgcggccggccccgtgcatccgtctcgcccctgccgatctactccccggcggcaagacgagcgctccggcgcccccagggaatgcggagcgatgaggcggcgctcaggcactgacgtcgccggccagcgcgagctgcgcggcgaccgaacctgccaccggaagcacgttgaggacgggtagacccatccacccatccttccttccatctgctagtcgtcgtcgtaggggtagtttgcagatagctagctcggtcgtttctagtagtggatcgatccaccgatcaggattcagccatgggtgagggggaggcggcggaggtgaagggcggggtgctgcagggccgctacgagctgggccgcgtgctggggcacggcaacttcgggcgcgtccacgcggcgcgggacctgcgcaccgggcgcggcgtggcggtgaaggtgctcgccaaggacaaggtgctgcgcgcgggcatgatggagcagatcaagcgcgagatcgccgtcatgaagcgcgtgtcccacccaaacatcgtggagctccacgaggtgatggccacgcgctccaagatctacctcgcgctcgagctcgtccgcggcggggagctcttcgcgcggatcgtgcgcgccggccgcgtcaaggaggacgtcgcgaggcggtactttcggcagctcatctccgccgtcgacttctgccacgcgcggggcgtgtaccaccgcgatctcaagccggagaacctcctcatcgacgaggcggggaacctcaaggtcgtcgacttcggcctcagcgcgctcgccgaccacgcgcacagcgacggcctgctgcacacgctctgcggcacgccggggtacgtcgcgccggaggtgttccggaacaagggctacgacggcgccaaggccgacatctggtcctgcggcgtcatcctctacgttctcctcgccgggtcgctaccgttcccggaggacaacatcgccgccatgttcaggaagatgagccgcggcgactaccggtgcccgccgtggctgtccaccgaggcgcgcaggcttatccccaagctgctcgaccccaaccccgacacccgcatcaccatcgcccagatcgtcgagacgccgtggttcaaaaagccgtccatcgggaagcccgtcaaagcagccgccgccgccgagcctgtctgctccgcgaaggacggctgcgacaaggacgagccgccggagacgctgaacgcgttccacctgatttccctctccgcggggttcgacctctcgccgctgttcgatgtggaaggtagtcccgcgaggggccaccgggagggcggcatgcggttcgcgacgcgggagtccgcgagcggcgtcgtctcccgtctcgaggaggtggccgcccgcggcggcgggcggatgcgggtgaccaagagcggcgcccgcggcgtgcggctcgagggcgcggagcgcgggggccgcaagggccgcctagccgtggcggccgacatcttcagcgtggcgccgtccgtgctcgtggtcgacgtcaagaaggacggcggcgacacgctcgagtaccgctccttctgcagcgaggagctccggccggcgctcaaggacatcgtctgggcggccgacccgcagcccgccgccaccgccgtcgtgtgacgccgtgcg

SEQ ID NO: 13 - DNA, 649 bp, Saccharum
ctatatccgctctaatactaggatcgatgtgctcagctcttgtgcgtgccgccgtccaagtttcactactgccgagtgccgagtagcttgtacagcatggcgagcgtcttcttctccgaggtcgcgccgtggcagctcgtccccgccgtcgccccgccgaggccggccaagctcgataccatcgtcgaggacgaggaggacatcttcagcgtcgtcagcatggcgcacgacgaggccgccgggtgctgcttccaaggtggggcttcttcttcgtcatcgtcagcttcggtggcgggcgccgcctgctcctgaaccggcctctacggcggtcggcgcgcacctgcagagtcgttgctgaggtgaaattatcgtgtgtgcgctcgggacatatatacccttgatgaattaatctctctctctctcttctctataaatataaataaataaagaagaaagtttatatatgtatgtgtccttagcaattatatttagacgttgcaaaagggcatgacacatcggtttgtgtaaaactatatgtatgcaatactttactatcttgttgacgaagtgactctcacgagagttcatgcattccatgtaattatattggtggtggttgtgtgtatgtacttagtttaccattgtcact

SEQ ID NO: 14 - DNA, 1369 bp, Saccharum
  misc_feature 493, 516: n = A,T,C or G
aatgcagcacataacgtctattatttatccacagcgtcactaccttgattacacaaaagatgtgatattacaacaacaaaatgggagctcggagctcgctgaaacaaacaagatggaataacagcagaacacaagacaagaccagaagggtgggggagagtccacagcagcaacggcgccggcagcctgaaccacgtcacaaggcacatacaaagtcaccgctgtcctcaacgtctacgtcatcgacatcaatgtcatccagctccatgctccccaggccggggagctgtcctgaatgcttcagcccgtcgccgggcttccgggcctcctgtatgatggccatgatctcgtccagactttgcgagggggcattcatgtccaccggctgtaggttcctctggtactcatcggtcatctcgatgggcaggttcttcaagaaccacgggtggttcttgatctctgggatggttatccgctgcatgaaatggatgantagaatgcagcactcttatgatnttcgttgcagaaaatgtgtctacagaattacttgctcagggttcgccacaaagatccgagacagcagatgtctgcactccatttaaaactgggacaaaatcaggaaccgcgtatgggacgctgagaatcgaagtaagcgtcttgcggaaatttcctcggttcgtcggggtcctcaaagggataagcaccaaccagcatcacatacagagtaactccacatgaccaaacatcggcaacctaaattgcacatggtgatgtttgagggctcggttttattaattaggatatttctcttattcggaagatgcagcaagtttgtgcgccactccactggaaataagaccacataggaaacaagaactagcgaagacaggaatcacctttccatcatactcctttctagcaaggacctctggagcaatgtatgccggtgtcccgacagttgattttggttgagagtgcaacagagaggactgggaaaaaaatctgagtatgatttatatagtgttcatttgtcggcaagctgcttactaaagtttataatctgcaataccttggagtaaccaaaatcacatatctttagccgaggtgctatactaccatccaggagagtgttttctagtttcaaatctctatgacatatttgctgcagcaaggaaacaaaaatagcattatgtcacagatgttctgctttaagttactaatcacatgttagttggagataactatataccattgaatgacaatagctaactcctgaaatcagttgttggaagaagaatcttgcctcatcctcactaaatcttccagctttgcagatcctttcaaatagctcaccaccagcagcatattc

SEQ ID NO: 15 - DNA, 861 bp, Saccharum
caaaatgattcacatgggcatgcaaagcgccagaggcaacggaatcaatgtcttcgatgaacatttaccaaatagcaccgacccaaaggaaggtctcccagcaagcataggtgcataggcaaagcatgtccaaccacctcactatggatggcaatgatggtaggccgacatcgtctacaatacgatcctagatggatcagggatacacacgaccagcaacaaatcgaaggaaacaatggcgcccaacaacgacttcttgagacgaaaggtattcgtcagcccatcgcatatttctgcgtccagctgcgagctgttgactcatatttcggccggtccgtcttgtacatgtgggcaatctcagggacaagagggtcgtccgggttggggtcagtcagcagggaacagatggagagcaggaccttagaaattgtcaaagcagggctccactgctctttgagaatgtcaaggcatatacttccattgctgttgatattaggatggaagacctttgtcttgaaagaaacctttggaggtttgaaggggtaatccggcgggaaatgaatgttcactaagaaaacaccgccagcatagggactgtcaggtggtcccataattgttgcttgccaatgaaacatgtcctcaccagcaggaccggcactgcatgatgtggggggatctttctgcaggtccttcagctccttgaggatacgcttcgatgccatgacaaactccttttgcaggcgagcagacgagaggttggggaacggggacggcgagaggagagagacgtcttctctttttttttctctctcttgccccgccccgggtgcctcgtttgtggtgtctcggacgcgtgggtcg

SEQ ID NO: 16 - DNA, 1120 bp, Saccharum
  misc_feature 69, 83: n = A,T,C or G
gcgtgcaccagagtggcgctagttagtgtgaccatccgtagcccccacctgaggccggcgcatatcctnccggccagcggcgnaatggtataagtccaaaatcggctcctttaacattcccatcccaatgcgatccacctggcaggaacctggcagggcggaactccaacgggtcaggccacagggccgggtcgcgggcaatgccccacacattgactagcagctcgcagcccttggggatgcggtagccggcaaccctcacactcctcggcagccatgcgaggaagggagaggggtgtcgatgggtgcagacggaacgtctccttaatgaccgcgttgaagaaggtgaggtgtcggaggtctgactcggtgaccaaccttccgcggcccacgacagcgtccagctcctcctgtgcctgtctgaggatgtccgggtggcggattagctcggccagcgaccactccactatggtcgacgtggtgtcggtccctgctacgaacaggttctggcgtgtccaggagtcatgcatgaacaatagacacaatgagcaactaggtattttatctcttaccttcattcgaagtcattagtagttttagctttgtactaagtttttgatcaagtttatagaaaaaaatatacaaatatcttcaacatcacattagatttattactgtgaattatagttaaccagtccatttatttatttgatagtgtagatattagtatatattttttataaacttggtcagataaacaagtttgtcttaattagtacaaaataaaaatgacttgcaatttcatggtgtatgccgcattttctacttgtctcacatcgctatatattgggttcggatgttgcaatcagatcaggtaaggctcgcgaatataggccatttatcatcgacagccgaaaccattagctagctggtcattttggtatcgtgaaatagagactgaacaactctctgatacgcacctacctctacctaaaagggttagtccttggaggtgcaagaggcacaagttagcacgactgggattttcgcttcgtcgtggtcttggcacctattgttatgattattattattcgaacctccatccacaaatgtacgtaat

SEQ ID NO: 17 - DNA, 601 bp, Saccharum
ggaacagaaagtgttggaggcaagcacaaacgatccttatgaatccgtgatctgggagaaggaagggaaattcacattcctcgacatcgtgaatgccaccgatagcttcaatgaattcttctgcatcggtaaaggtggctttgggagcgtgtacaaggcggagctccctagtgggcaggtcgtggccgtgaagcgcttccatgtggctgagacaggagacatatcagaagtgagcaggaagagcttcgagaacgagatcaaggcactgacagaggtccgtcaccggaacatcgtcaagctccatggcttctgcaccagtggagactacatgtacctggtgtatgagtacctggagaggggcagcttggggaagacattgtacggggaagagggcaagaagaagctggactggggcttgagggtgaaggtggtccagggggttgctcatgccctggcctacctccaccatgactgtagccagcccattgttcaccgtgacatcactgtgaacaacatcctgcttgagtcagaatttgagccgcggctgtctgattttggcacggcgaagctgcttggctctacttctacaaactggacttct

SEQ ID NO: 18 - DNA, 586 bp, Saccharum
aacgtcagcgaggctgagaaagtctccagccagatacctggacttggtcagacgtgcctcatacacctctagcaccttcttcagcttctcaaggttctcatcgacaactttctggtcagtggttcccccaagcatcggactgatgaggacctggaagaggatgggattcagtacagaggtgtactggtttgcctccacctccatccaaacatccaccattgctgactcctcaagatttccttccctcaacagctctggtttgtttttgcgagcagcatacttgcagattgcgcgtgattcgaagaggtacaagtccccatcttgcaaagctggaacctgaccaaacgggttgcgggcgaggtgctcggggctcttgtgctcagcggtggcgaagttgatgggcacgatctcgtagtcggagccggcctcctccagcgccgtcgcgcacctcgtcacgttccacgatagcaccgccccgtacagcttcatcggagccatggtctctcctctctctccgaacccagccttcctctcctctcctctaccctgtttgtttgcctggggattctctgcggacgcgtgggtc

SEQ ID NO: 19 - DNA, 1357 bp, Saccharum
cgtgctcctagccgtttccgtcttcgtcttctccctcgcagttgcttccttctgctgcagcgcctttattgcactcacctgccctgccaactcgtcgtccagctccagcagtggagggcgcgcggcggagctaccatagcacaccaagcggcgacacgccatgcccccagctgccacagaaatctaatataattgcagtgcagccccaacctccttgttcctcttcctctgcttccccttccccttccccttccccagctagcgcctagcccccaccgtcccggccgtaatcaatcaatctgctttcctagctcctactcgccggagaagaggaaggacacgccacggagcctgctcccttcaattctcagagtaaaagttgcctcaagaagattcctctgctctgctgcatgttgaattcgagctccacaaggctaccgtaacaactaacaagtgtggatatgaattggtgttgtcttcctagtagacgagccaaggaagaggagaatccttactccaacagcataggcggtatttattctgagaagaacataaggctcttctcctatgctgagttaagatctgccacagacaacttcaaccgctcaaacaaagtaggtcgaggtggcttcgggacagtttataagggaaccattcgaaatgggcgagaggtcgcggtaaaagttctttctgctgaatccaggcagggcatcagagaattcttgacagaaattgatgtcattaccaacgtgaagcatcccaaccttgttgaattaattggctgttgcgttgaaggaagtaacaggattttggtgtatgagtatcttaaaaacagcagtcttgaccgtgcactgttaggttctaacagtgagcctgctgacttcacctggagcataagatctactatatgccttggagttgctcaaggccttgcttacctgcatgaagagatcgcatcaccgattgtacacagagacatcaaggctagcaatatactacttgacaaaaattacgtccccaagatcggggattttggtctggccaagctatttcctgataatgtcacccatatcagcacccgagtagctggaacaacaggctaccttgcacctgaatatgcatggcatggccagctaaccaagaaagcggatatatacagttttggtatccttgtcctggagatagtgagtggcacaagtagttccaggagcatactgatggatgacaaggttctcctagagaaggcatgggagctatatgaagcggagaggctcaaggaactggtcgacccagcccttgtagactaccctgaggaagaagtcatcaggtacatcaaggttgccctcttctgcttaca

SEQ ID NO: 20 - DNA, 1757 bp, Saccharum
agttccattccttggaaaaaccttcaaacgcccttgcagtgaagcggacgaatttgagtagagcccagcgatcgattagaaagaaagaagcaagcatccaagtctctatggcgagctccgatcgtggttcggccagcgcccccaaggaggtgccgggcagctacgggctgccgctggtgggcgccgtgcgcgaccgcctcgacttctactacttccaggggcaggacaagtacttcgagtcccgcgtggagcgctacggctccaccgtggtgcgcttgaacgtgccgccgggccccttcatggcgcgcgacccgcgggtggtggcggtgctggacgccaagagcttccccgtgctcttcgacatggacaaggtggagaagaaggacctgttcacgggcacctacatgccctccacctccctcaccggcggctaccgggtctgctcctacctcgacccctccgagcccacccacaccaaggtgaagcagatgctcttctccctcctgctctcccgcaaggacgacgtcatccccaccttccgctccaacttctccgcgctgctcgccaccgtcgagtcggagctcgccaagggcggcaaggccgagttcaacaagctcaacgacgtcacctccttcgacttcatcggcgaggcctacttcggcgtgcgcccctcggcgacggacctcggcagcggcgggccgaccaaggcggccaagtggctcatctggcagctccacccgctcgtcacgctcggcctccccatggtgctcgaggagccgctgctccacacgttccacctcccgcccttcctcgtcaagggcgactacagggcgctgtacaagtacttctccacggcggcgaagcaggcgctggacaccgccgagggcctgggcctgtcgcgcgaggaggcctgccacaacctgctcttcgccaccaccttcaacagctacggggggctcaaggtgctgttccccggcctcctggccaacgtcgccagcgccggcgagaagctccacgagaagctggtcgccgagatccgcggcgccgtggccgaggccggcggcaaggtcaccctggcggcggtggagaagatggagctggccaagtcggtggtgtgggagtcgctgcgcctggacccgcccgtcaagttccagtacgggcacgccaagaaggacctgcagatcgagagccacgacgccgtgttccaggtgaagaagggcgagatgctgttcggctaccagccgtgcgccaccagggacccccgcgtgttcggcgacacggccaaggagttcgtgcccgaccgcttcgtcggcgaggagggcagcaagctgctgcagtacgtgtactggtccaacggccgcgagaccgagaaccccagcgtcgacaacaagcagtgccccggcaagaactttgtggtgctcgttggcaggctcttcctcgtcgagctcttcctccgttacgacaccttcaccgccgaggtcggcacggagctgctcggcacaagtgtcgtcttcaccggcgtcaccaaagctacctccggcccgggcagcgagtaagcgtcattggttggatatgattggagggtcccatttcctatttcgtcccctttttccgcttgtaataggatttctctctctttcctcttcacgtgttttcggattggaggtgtttgacgcttttgtaatgtaataatgcatgttggcatgttgcataaattgctccagaaatcttatctttcacaaagaaacccaaaaaaa

SEQ ID NO: 21 - DNA, 2185 bp, Saccharum
aagcaaagcaagcgacccaaattctctccgttttctccagatctcgagttccgctactagtagattccttcttagcgttcgagtgagcgattctggtggcaatggcgaagagcgagggtccggcgatcgggatcgatctcggcaccacctactcgtgcgtcggcgtgtggcagcacgaccgggtggagatcatcgccaacgaccagggcaaccgcaccacgccgtcctatgtcgccttcaccgacaccgagcggctcatcggcgacgccgccaagaaccaggtcgccatgaaccccaccaacaccgtcttcgatgccaagcggttgatcggcaggaggttctctgacccgtcagtgcagagtgacatgaagctatggccgttcaaggtcatcccaggccctggagacaagcccatgattgtagtcaactacaagggtgaggagaagcagttcgctgcagaagagatctcctccatggtgctcatcaagatgagggagattgctgaagcctacctcggctctacgatcaagaacgcagtggtgacggtgccggcctacttcaacgactcgcagaggcaggccacaaaggacgccggtgtcattgcgggcctcaatgtgatgcgtatcatcaacgagcctactgccgctgctattgcctacggtcttgacaagaaggccaccagctctggcgagaagaacgtgctcatcttcgaccttggtggtggcacgtttgatgtgtcgctcctcaccatcgaggagggcatcttcgaggtgaaggccactgcaggtgacactcaccttggaggtgaggactttgacaatcgcatggtgaaccacttcgtccaagagttcaagcgcaagcataagaaggacctcagcggcaacccccgtgcactgcgccggctgcgcacggcgtgcgagcgcgccaagcgcacgctgtcatcgacggcccagacgactattgagatcgactccctgtttgagggcatcgacttctactccacgatcaccagggctcgcttcgaggagctcaacatggatctgttccgcaagtgcatggaacctgtggagaagtgcctgcgtgacgccaagatggacaagagcagcgtgcacgacgtcgtgctcgtcggtggctccacccgcatccccaaggtgcagcagctgctgcaggacttcttcaacggcaaggagctgtgcaagagcatcaaccccgacgaggctgtggcgtacggcgcggctgtccaggccgccatcctcagcggcgagggcaacgagaaggtgcaagacctgctcctgctcgacgtcacgccactgtcactcggcctggagactgcaggtggtgtcatgacggtcctcatcccgaggaacaccaccatcccgaccaagaaggagcaggtcttctccacgtactccgacaaccagccgggcgtcctgatccaggtgtacgagggtgagcgcgcgaggaccaaggacaataacctcctcggcaagttcgagctctccggcatccctcctgctccgcgcggggtgccccagatcacggtcacctttgacatcgacgccaacggcatcctcaacgtctctgccgaggacaagaccaccggccagaagaacaagatcacgatcaccaacgacaagggccggcttagcaaggaggagattgagaagatggtgcaggaggctgagaagtacaaggccgaggacgaggaggtcaagaagaaggtggacgccaagaacacgctcgagaactacgcctacaacatgaggaacaccatcaaggatgacaagatcgcctccaagctcccggcagaggacaagaagaagatcgaggacgccgtcgatagcgccatcagctggctggacagcaaccagctggctgaggtggatgagttcgaagacaagatgaaggagcttgaggggatctgcaaccccatcatcgcgaagatgtaccagggcgctggcgcgggcatgggcgatgctgctggcatggaagaggatgccccgtctggtgggagcggtgctggtcctaagatcgaggaggtcgattaagttggttagtgtatgaggtttggtttggtgaggtgtgaagtacatctgaactctgaaggttgtttgtgagaagtggtgttgcagtagctgtgtactgtggtcaaacttttcagaaataagtgtccgtaatttgtttt

SEQ ID NO: 22 - DNA, 690 bp, Saccharum
tttttttttttttttttttttttttttttttttttttttttttttttttttgcaagtgacagatatagaaaatacaataatcccagggttgaattccaccagaaaacacggaacatccacagaatacacaccagcctagtctgatccaatcaacatcgacagagtactagtagtctcatcataacagagaaaaaaagagggcgataatgcaggacaaagctagaatagaagcacgctagctagcatttcaagctcagttcagatccagctcttccataagctagtagtagtttcacttgcagtcgtgttgaatccgtcggatcgccctctcagaagcaggcgtccaggaggcagcagcagcagagggcagccaagcatccctccatgaaggaaggcccgctgctctgctgctgctgtggaggcggctgcgcgtactgcggcgggtagccctgctgcgggtacccctgcggcgggtaaccctgcgccggcggggggtagccggccggcgggtaccccgctggcgggtagccgtccttcgccgggtagccttgctgcggcgggacgccgacggggggctgctggccgtagtagctcatcttcctcttcttacttgcgatcggaggcggcgcgacgcgtgggtcaggggagctctcgctgcttcgggttggggggttgaggcgtgacgggaat

SEQ ID NO: 23 - DNA, 468 bp, Saccharum
gggtcgacccacgcgtccgtaattaataaagattaaaagctggcataaaatgattgatctaaatatcattcatctttttatttccattcagaaataatattcaggaagttttattcatctgtattttagggaaaacattttacggtataaaaaagaagttgatttttttggttgaatgtgtaatttttttctctgtaaaaaatagtagtatttaaaaaaatgtcagtatagtagtatttctatagcctcggctttcttacaattttgtaacatatgcctatgtgcctgctatgtacgatgggtggatgttgaatgattctatgtgttcattaaaataacacctaagtacataggcctatctaagctactttgtgtgttaggtatataacattcactgaattgtgataaggttgcactaattatagttttatatttatactgtataagatatataaatgctaaaatttc

SEQ ID NO: 24 - DNA, 785 bp, Saccharum
  misc_feature 556, 566, 645, 751: n = A,T,C or G
cgcaagagcgggtcgacggcgctggcgagcctcgagtactccaacgcctgggacccgctggccgacgcgcgcggcgggctgggcttcctctcgcaggacgtgctggcccagagcctgcggatcagcacggaggaggtggagtccgcgacgcgctacttctcggagctcaacctcctcgggaagcgcggcaagaaggccggcggcctcgcggccacgtacaggggcacgctccgcgacggcacctcggtggccgtgaagcggctgggcaagacgtgctgccggcaggaggaggccgacttcctgagggggctgaggctgctcgcggagctccggcacgacaatgtggtcgcgctgagggggttctgctgctccagggcgcgcggggagtgcttcctcgtctacgacttcgtgcccaacggcagcctgtcgcagttcctcgacgtcgacgccgacgccgacaacgccggcggcggcagcgggtgtgtcctcgagtggtccacgaggatctccatcatcaagggcatcgccaaaggaattgagtatctgcacagcacanggacgaacangcccgctctcgtccaccagaacatctctgcggacaaggtcctgctggactacacgtacaggtacaaggcccctcatctncgggtgcggactgcacaagctactcgtggacgacctcgtcttctcgacgctcaaggccagcgcccgcatggggtacctcgcgcccgagtccaccaccgtgggccgnttctcgagaagagcgacgtctacgcttttggggt

SEQ ID NO: 25 - DNA, 1424 bp, Saccharum
ccccgcgccatcaccgcagcaaccaccgcccgcccggccgcgtccctcccctccgccatccgcccgcccgcccgctctccagcaatggcgtccggctcgcacgcgacgacgccgctgctcaaggacgagctggacatcgtcatcccgacgatccgcaacctcgacttcctggagatgtggcggcccttcttccagccctaccacctcatcatcgtgcaggacggcgaccccagcaagaccatccgcgtccccgagggcttcgactacgagctctacaaccgcaacgacatcaaccgcatgctgggtcccaaggcctcctgcatctccttcaaggactccgcctgccgctgcttcggctacatggtctccaagaagaagtacatctacaccatcgacgacgactgcttcgttgccaaggatccatcagggaaggacatcaatgcacttgagcagcacatcaaaaacctcctgagcccttctactccatttttcttcaatactttgtatgacccttaccgtgttggcgctgattttgttcgtgggtaccccttcagccttcgtgagggtgtcccaactgctgtttctcacgggctttggctcaacattccagactatgatgcccctacccagcttgttaagccccttgagagaaacaccaggtatgtggatgctattcttacaatcccgaagggcaccctcttccctatgtgtggaatgaaccttgcatttgaccgtgagctcattggtcctgcaatgtactttggtcttatgggtgatggccagcctattggtcgctacgatgatatgtgggcaggatggtgcacaaaggtgattacggatcatctgggcctgggtgtgaagactggtctaccctacatctggcacagcaaagcaagcaacccgtttgtgaacctgaagaaggaatacaacggcatcttctggcaagaagagctgatcccgttcttccagtcagtctcccttccaaaggatgccaccaccgtccaaaagtgctacctcgagttggccaagcaggtgagggcgaagctcggtaaggtggacggctacttcaacaagcttgccgactccatggtcacgtggattgaggcctgggacgagctgaaccccccaaaaggcggtgcccccacagcaaatggccctcctaagaagtaaaacacgatatagtataaacttcacttgttcatgtgaaccgtcatactgaaaggaaatactgtttttgattagtcttatggactgagatcactctgctgtaacacaagattttcacttcctggaaaccgtcgtgtcggttttagggcgtttacacgtttttccctttttcgtgtgatgcaacaggtgtatgtcggattggattaccttcaatttataataaagtttacggattatggtcttgatctttcccccag

SEQ ID NO: 26 - DNA, 1266 bp, Saccharum
gaaaagaaacgaactcgatcgctactattcgaaaacttggcagttgtacatccagtgttgtagaaacaaatgaaagaataatgcgacatgcgtgctacatttacattgccatcgcccatggcaaaaccaaacattattcgccagaccagaccagaccagaccaccgatctctctggtttccaccacggcgaggccgaacgacgagggatcgtgcacgttggttcgtcttcgttcagtcatcgcatccaacgacctcaccggagcttgcactcggcgggcaccccctgcgggaaccgcttggcgtcggtgcagtagttgtagatcatgaacttcctctgcacccagcgcatgcggcggtaactcatatcactaagctgctgattccaccagctgcctccgcgccgtcccgccgccgccgccgcggcctccatggttcccacagggcactgctgcttgccattagcccagacgcaggcgtcggcgctgaacccacggaacgacgccacgaacggcgcctgcgaccagtccgccttgactctcccgccctgcgtggcccagtcgtcggcgttccagagactcgcgtacagccgcatgggctgcgtccgcgggaacgccaccccgcgcgcctcgtggttcttgaagtcccggatcggggagccgtccaccgcgaagatcacgtgctgcgggttccacaccaccgagtaggtgtggaagtccttggtggggtcgaaccagagccggaactgctgctcccgctggccctgcccctgggtgaacacgttggtgtgcagcgtgtacggctcgccggagacgttgccgaggaactcgaagtcgatctcgtcgtgcgcgctgccggcagaggagaggtagaaggtggtgacggtgccggcggagttgccgggcaccagcttgatctgcatgtcgatcttgccgaagaggtactcgttcttggactggaagccggagccggaggtcttgtcgagggtcaggtccagcccgcgcccgccgtccaccaccttgcctcgcccttgcccccaggtcatctccgtgtcctggtagaagttgccgccgtgtgcgacggccgccatgcacgccaccgcggccacgaaggcaactagcgcggctggcctcatcttcttcttcttcttctcggctcacggctctagctcgtgagtttgactgccggagctctagctagtgatagttgtgtgtagtgcgtgtgcgggggaaggaactttgaactcgcccacgcgtgggtggacccgt

SEQ ID NO: 27 - DNA, 692 bp, Saccharum
gcgtccgcgcatcatggagttcggttgtggtgcaggtggttgttgctctgctgcgcccccgagcagagctttttgcgctgagtggcagtgcctgctgggcgacctaaaaccgcacctcgggccgcgagctcgccagggttgtttcgcgcgcatggagccaccagcagctgggtgcagcgggaggacgatggggttccttcttgtcatggccgtcctgctctcggcgtgtgcccgagagtcccttgccatgaccgacagccaggacagttctgtgctccgggcgttgatggatcagtggcagaacacgccgccgtcctggggacagtccgacgatccctgcggagactcgccgtgggaaggagtgacatgcggcaacgacaaagtgatctccataaaactttccaccatgggcatcaaaggaagtctagctgctgacataggccagctcagtaacctgcaatccctggacctgtcattcaacaaggacctcggcggcgtgctcactccgaccatcggaaacttgaagcagctcaccaccttgattctggccggttgcagtttccatggcaccatccctgatgagctaggaagtctgccaaagttatcctacatggcactgaattcaaatcagttctctggagaaataccagcttcgctgggaaatctctcgagcctctactggtttgatatca

SEQ ID NO: 28 - DNA, 929 bp, Saccharum
tttttttttgggggtgttttttttttagatgcaaggtaagtgaatttcagaatagtcacgacacaggccaataatgagtacccattgaaccaggccagacaacttatcataggttgacatggtcatattctgctgtcatacactatctccaaaacatgagtagaagcaaaagttacaacactgctcagtgctcactgcttgaacccacaaatatacaacctacaggggcgtggcccctctaagtccagttctagtgcacttgtgcagtgcgatatcctgccaatggggatgctgctgctgctgctccaagcgagcgccgtggtgaaggttgaactctcattggcgattttggggtggtgctcattggcgattttggggcggcgtgtgaagctttccgtatgtcgactaatggtgatggtgaaccatatttggcatcttgtagctgttccagctcttccaacacctgtgacataggaggccgcagcttggcgtcaccgcaaatgcattgcaaggcaatgcttgcaatggcatttgcgcctttttttggatactgtcctcccagcttcgtgtccatgatacggtatagtctgcgcttgtcacccaagtgaggtctggcccagtcaactaggtttctgctcaaagcctggttttgattaatccaagggcccttcttccagtgagcaattcaagcaacaccaccccgaagctatagacatctgcctttgcagagaggcggcctgttgcaatgtactctggagctgcatatccatgagtacccatgacttgtgtggatacatgggttttatccccagttggaccggcttttgctaagccaaaatatgaaagttttgcgttgaagtctgaatctaacagaatgtttgatgccttgaaatcacgatatatcacttggttttcagcatcatgtaaaa

SEQ ID NO: 29 - DNA, 604 bp, Saccharum
  misc_feature 5, 532: n = A,T,C or G
caggntcccccacgcgtccgggacaagatcacgagggttgggctaattttgcagataaagagggaaatctctataatgagactggtaaagcatccgaatgttctgcaactttttgaggtaatggctagcaagagcaagatttactttgtattggagtatgctaaaggtggtgagctgttcaacaagatctcaaagggaaagttcagcgaggatgttgcgaggaggtatttccaccaactggttagtgccgtggactactgccacagccgaggtgtttaccatcgcgacttgaagccagaaaacctacttctagatgagaatgagaaccttaaagtctcggattttggtctaagtgccctagctgaatccaaaaggcacgatggcctcctacataccacctgtggaactcctgcttatgttgctcctgaagtgcttagtaggagaggctacgatggcacaaaggcggacatatggtcttgtggagtcattctttatgtgcttgtggctggttacctaccattccatgacccanatcttattgagatgtataggaaagatttccaaagctgaatacagatgcacctcgttcccttttcttggtgaa

SEQ ID NO: 30 - DNA, 972 bp, Saccharum
  misc_feature 534: n = A,T,C or G
gcttgccgcgggctcctatcgctcatccaccaagctccccgcgccgagatgtccgacggcaacgagtttgcagagctgctatgggagaacgggcaggcggtggtgcacgggaggaggaagcagccccaggccgccttcccgcccttcacttgcggcgctgccagcagcagcagagctcaagaaaagcagccaggtaccgacccggtggcgctgttgaagcagggaataaaatctcggcgagaaaaaaccgagaaatccgataatcccgtttatcgctaaggtccggtaaattttatttatcgccgagattgcaattttcactagtccacctccatgaaagtataatattatgttatattaatgctattgcgtactagttctcaatgttaaatgctttagagagaactttagtaattttctagataaattaggtattttttgttttattttttgaccgagaaattttccgagaaatccgataaacccgtttatcggtgacctccggtatttttttcctatcggtaaagcgaaccntgcctccagccatggaacgtcgtcgtccatggtggaggatgtacgcagagcaggtatggactggatggactcgacggttctacaatcgtcaagtagtatgtatgtgtataccttgggcggaggagggcctggttggtgtgggagtaggcgaggtggccgaggtcgccgagctgcaccgacaccgccggctcggaggcccccaggaagcggccgacgagctcggacgccctggtcttgggcgacggcgtccggctgcccgccgccaccagctccgccggcacctccaccaccccgccgctgaacaccgccaacatcctcgctcgatcactcacacctccttcctactagtaactagtaatcctactcctaatctcctcgcaagcagaagctgccgctgacggatcaaggtatcataagaaagaaactgatgctgtttct

SEQ ID NO: 31 - DNA, 1064 bp, Saccharum
ctcgaggcccccgccgccggatccgccacggacgagcctgccgccgcgctgcgccaccagatcgaggccgccacgactggatcaggggcgccgcagccgccatggcctgctcctggctgcgccctcaccggatctgggagagggagcaggggcaccctcacctaagcgcgcgcgtcggcgtggacgagcgcgtcgcggctgctccggcgagtgagctcggcgtctccggcgcacacgggcgagcgcggctgctctggctggcgagcgcaagcggcggcacgggtgtggcagcggcgctgtcgagcacggcagcgcggacaccgcgtgtgagcgcggccggcggacggcgagctctcgcggcgcgggcgagcgcgcggcgaacggcgaggtcgtggcggaggcggcgcgggcgagcacggcgggcgcggccccggcagcgtgtgcgagaaccggtggtttcttcccaacggtgattcagtcgtttccatgtgcctcggtgcaagagtcgacttcgtttctccccgacgaaacgatttctacgggattttcgctctctctcgtcattaactcgggtgccacgtcagcgttctctccacgttaaatgcggttgaagacgacttcttaaatatcggtaggactgcactaaggtttgttgataaagttgtttcgctcgatgccgtgcagaaaagttatagtgtcgatcaccttctcagaagaagaaagacgccgagtcgtcgagaagcaggaggaacaagaatgaataggcagtcgcgtggaagatgttcccaaaaacctgattgtcggttttcacccgatcaaatgaactcacaaacaacgccggttttggaggccggtctccctattctgctctccctattcctgtgcgtgcaggaactgggacggggatgaccgagagcaactcaacagcgaattggtgagacgtggttgtgtgtcatgcgttcgcggacaagagaagactgccgccttatgtagccttccaggacatgaagagataagtgtaatggttgataatgatcatgaatatcatgtatgttaccaataac

SEQ ID NO: 32 - DNA, 987 bp, Saccharum
gagacgaaatgcctgcctggctgtctcacaataaaaaaaaaaaaacggaaccacatgctccggatcgcccctttcttccaacacgatgagtcgtgaagggaaaaggacgcaaacatggactcgcctggagcatcatccgacgcaaaacggttccaagcaccagtttttgacattcagaattacagcttccaagtgacacaatacagcagcattcagcaccacacggagtgcactgtactgcaaacccaatttgattcatcattatacaggacagatcgaatacatggagacacgtccagtccaggtccaggaacacaacgcagcagcagctgacgattccggcgacccggccccaaaggccaggcaggtaggtactactacatggcgtacctctgggtccaggtcctcgcggtgttctcgtacttgtgccggtccgtcttgtacatgtgagctatctccgggaccaaaggatcgtcggggtttggatcagtcagaagggagcagatggacagcagcaccttggagatggttagtgccggactccactggtccttcaggatgtcaaggcaaatgctcccattgctgttgatatttggatggaacaccttggtgcgaaacgccacctttggtggtttgaaagggtaatcaggaggaaaatggattgtaactaggaaaactccaccagaatatgggctatcagatggacccattattgttgcctgccagtggaacatatcttcaccaacgggacctgcactgcacgaggtgggagggtccttctgcagatccttgagctctttctgaatcctctttgacgccatctcccccttcctgtgccctcctgcctagctgaagaactgctgtttctcctttgcttctgcctctcgccttcccctctctctctcttctcttttgtcaaggatcaagcaaataatggagttggggctggggaaaggaaccgggacaaagggcatatatgtaaatggg

SEQ ID NO: 33 - DNA, 950 bp, Saccharum
ctccatatcacatagagagagagagagggagggagacaggagagaggaagacagagagagatgcggtaacccaagagaactgctcttatgcatgaagcagccataagcattgctattagggtttcatgcagggcaaagcaactgatttctgccgcctgaaagccgccggaatctgcgaggccttcccgagcagcgtcatcggataaggcagccggcacggcaatgccggttccccttgccccgtatccgactcctccggtgccattcacgcctcccaatggggggcaaagccagcttgtctgcaccggatgccggaatctcctcatgtatccagctggtgcgacgtcggtctgctgtgcagtttgcagcaccgtcaccgccgtgccggctccaggaactgagatggcacagttggtttgcggaggatgccacactctcctgatgtacatacgtggtgcgactagtgtacaatgttcttgctgccacactgttaacctggctatggaagcaaatcaagttgcgcatgtaaactgcgggaactgccgtatgctgctcatgtaccagtatggagctaggtctgtgaaatgcgcagtctgcaattttgtgacatcagttggggcttcacctggtgcagagcagaagcctagcaactgatagtgtccctgaaaatactgagatcacctatgaaggcagcttctgaaaggatgctttgagtgcacatgtatagagttcttccctgaagcaattctttttttgtttctcctcatctccattctcccccatccccttctgcgttcgttcgatgaatctggcgtacccgcggaataaatgagagttttggaaataactagggctcaacctcgtcgacttgtctgtaaaatcaaatgagacatatataaacctatgttattttttttttgtttctgaatttctgaatgtttctctgactg

SEQ ID NO: 34 - DNA, 573 bp, Saccharum
tctcccgccgccacctccgccgccgccgcagccaaaaaccctaaatccccccaatccaccaatggcggcgagcagcgccgacctggccgacgacggcttcgcggcgccgcgcctcttctctcagggcgtctcctacacctacgacgacgtcatcttcctgccggggtacatcggcttccccgccgacgccgtcgacctctccacgcgcctctcccgccgcgtgccgctctccgtcccctgcgtcgcgtccccgatggacaccgtctccgaggccgccatggccgcggccatggcctcgcttggcgccgccgccgtcgtgcactgcaacaccgagccccatgcacaggccgccatcgtccgcgccgccaagtcacgccacctccccttcgtctcctccgtgcccttcttctccccgtcctccgccccgacgctcaacgacttcgctggcaacgagtacgccctcgtcaccgagcacggagattcgctctccaggctcgtcggcgttgctgtggcagcagatgctgcctcccgcgaggttcctgtcgctgtctcggagtacatgcgaccgacacc

SEQ ID NO: 35 - DNA, 432 bp, Saccharum
ggcgtatctcgtcatgcccggagcccatcggcggcaccctgaggaggcgcggcgagtcggcgaagttgaggcaggcggcgcgcccccgcagcgtgagcgcggcgacgtcgtgcgcgcgcgccgccatctcggcggtctcgaaggtcccgagccatatccgctgcttgccgtgcggctcccgcacctcgcagacccacctcccggggttcctccgccgcacgcccttgtacacggggtgccgcgtctccttgaacttggtccgcccggctcgccgcttgggcggcgccgacgacaccgtcatgtacgacgaggaggagccgtcgtcgccgccgccgacaggggacggcgtcccagaggagtagtcgctcaaggatccggcgtccatgggtgaagcgcgggtgtggtagtggccgtggcgagctgggggaggag

SEQ ID NO: 36 - DNA, 1756 bp, Saccharum
cggccgcgcgagctaaggaagaagcccggatccggatccttgggggacctgtgctggatctgcgccggaagcgaggcggcggtgtacagcaggctgcgacggtgtgcggtcgggctgcgccggtttccacttcctcgaccttggacgctgctgcctgcgtctgagcaggtatggtgctcgcacccaccggcgctgcattctctgtactatggggttgcctcctctgcgtacttggctgacgttttgctggtttgttcttttttttatttcttattttcggatttgggcgcatttgcgctatggccgtgttgttgtgttcttatataccagttcattctggtttccatgctcctaatccacgcagaggaaatcgatgtttgttgttggcgcgtcgtacctagctatctttgctgcaggtggtggcggctcggtgtgggcttgccttatgcgtccgtggtctctgaaatggctgaagatggttcgcccatctatggaattgaaattgatgtaccatgcgtcggagctatagtgccttacggtagttattttttttggtcacctcctgatgcgttgtcgggtgctgggtatcagcaggctgctctacaggcgatagcttttttgcagactctttatgggttcgtggttgtggattatagcttccacggtgcccttctttataggaaaatcgcaagtgcggctgtttcgggtgctgctagggcggctgggatggtggatagattgtctaaagaaagagaggagtttgttgtgcactctgactgtctctgaaagagatctccttgcttggacagactgtgtatttgctttgcagctagcctggatccataataagcactgctctttttcggctgtttggtgtggtttcactaccctggtgttgcttcctgcgatgcctttgccccggcgtgctcgtggtgaagcatgtatgtagtcttgtctagcgctttgcgtgtcttctacttttttttttctatcactgcctcgtggtcttgcacactgtcttggatacgtctgccttaattttcccctgcagactccccctccggcacttcatgatggcaacacgccactatctaaggtggagcaaggaagaccgaccatccaagcgctcggaagagactgattatggaagacaatattgctgaagagtcggctgatgaacattccaatgaggcgtctccagacgctacccaggtgaaggacactgttgtgtgctcttcaggcgaaagtgtcaagcaagatgcagctcctgctgcagacaagaagaggcttcgtggaagccgttccctcgctgagaagagtggctagataagctacccatgccgtgcgggcgcttttgcttggatggagtcgcttcatttggccatccagtggagacctccgcctgtttttgccggtgcagtgcgtttctgcatagttttgctggtccagtcctccgcactggaaactaacttccactgccgtatgaccatgaaggatgtgagcatttaggcacgaagaactcctcagattgttaggttacattgtggggcctgtatatgttaactgtcgctagatgtcccgtgcccagaaatattggcgcgacgcctggtcgactggcttctcctctgtgcactggccaaactttggaccatttgattcggtatgctgaggcattgcgttctgtaactgagctactgcgctgcttcgtgtaatgtaactgcgacatttgcatgtttcgtgtttgtttgggtgtctc

SEQ ID NO: 37 - DNA, 603 bp, Saccharum
cacacagccaaagagcagaactgcagaagcaagcagctgggggctagctagtgtgtagctaccgagaaagctagcagcatagcaatggctgtctctgtttcttgccttagcctgttggccgtggtgctggcggcgctggcctcggcggcgtcggcgcagctgtcgtcgacgttctacgacacgtcgtgcccgaacgcgctgtccaccatcaagagcgccgtggatgcggcggtgatgcaggaggctcgcacgggggcgtcgctgctccggatgcacttccatgactgctttgtgcatggctgcgatgggtccgttctgctgaacgacacgtccggggagcagacccagcgtccgaatctaactctgaggcgcttcgatgtcgtcgacaacatcaaggcgcaggtggaggcggtgtgcccgggggtcgtctcctgcgccgacatcctcgccgtcgccgcccgcgactccgtcgtcgcgctcggcggaccttcgtggaccgttctactcgggagaagggattcgaccgcttcattcccgagcgagacaaccgacctcccagctcctacaaatagcctccaacaactgttatctgcgttcaacaag

SEQ ID NO: 38 - DNA, 1086 bp, Saccharum
cggacgcgtgggcggacgcgtgggcggacgcgtgggcggacgcgtgggcggacgcgtgggcggacgcgtgggccagcccgtcggacggctggtgctggacaagaacgtggacaacttcttcaacgagaacgagcagctggcgttcggcccggggctggtggtgccggggatctactactccgacgacaagatgctgcagtgccgggtgttcgcgtacgccgacacgcagcgctacaggctggggcccaactacctgatgctccccgtcaacgcgccgcgctgcgcgcaccataacaaccactacgacggcgccatgaacttcatgcaccgggacgaggaggtggactactacccgtccaggcacgcgccgctccggcaggcgccgccggtgcccgtcccggcgaggcccggtgatcgggaagaggcagaaggcgaccatacggaagccgaatgatttcaagcagcccggggagaggtaccggtcttgggacgccgaccggcaggagaggttcgtcagaaggtttgctgactcgctcggtcaccccaaggtcagccaggagctcaggtccatctggatcgacctcctctccaagtgcgacgcatcgctggggatgaagattgccacccggctcaacatgaagccaaacatgtgagtgatggcgaattggcgatggagctgctggctgctactactgctagtagtgaagtgaataagctggtgtggctgagcgaggcgtgtccgagttgttcttcagtactaatcgtccaccgccgttcgtctttcctttccttgtcatcgtcgtcaagtcatcaagaaataagaagagcagcatgagcatgagacatacgtacatgtcaacagctagtacacgacgacaaagcagcacatgtgcatcagatcgatgcatatccttagcccaactatagcccgtgtatgcgtgtccggatttgtctgtagcaatgcaagtcaagcgaaatggctctgttttttttattattacagcatgtaccctgctacttgaaactgaatgtatatcgagttattaaatcaaagcagcattattactccctcaaaaaaaaaaaaaa

SEQ ID NO: 39 - DNA, 2236 bp, Saccharum
aattcccgggcgggaggtgcctcgatgaagtacatggcaacatagagttcaaggttagtggccttcagctatccttcccgcccggatgtcatgattttccgtgatttttctctcttcttccccgcggggaagaccgcagcggttgttggaggcagtgggtctggaaagagcacggctgttgctctcattgagcggttttatgatcctaatcaggggcaagttttgctggataatgtggacatcaagacgctgcaattgaagtggcttagggagcagattggtttggtgaatcaggaacctgcactttttgcaactacaattcttgagaatattctttatggcaagcctgatgctacaatggcggaggttgaggctgcagctacttcagccaatgcccatagcttcattgctcttcttcctaatggctacaacactcatgtgggagagaggggacttcagctctctggtggtcagaagcaacgtattgccattgcccgcgcgatgctgaagaatccaaaactcctgctactagatgaggccactagtgcactcgatgctggttcagagaatatcgtccaagaagcccttgatcgattgatggtcggcaggacaaccattgtggttgcccacagattatcaacaataaggtgtgtcgacatgatcgctgtgatccagcaaggccaggttgttgagactggtactcacgatgaactcctcgccaaaggaagctccggagcatatgctgcactcatcagattccaagagacagccagaaatcgtgcatgcccatcaacccgcaagtcccggtcatcccgcttgagcaattccctctccactcggtcattgagcctcaggtcaggaagcttgaggaacctaagctactcgtacagcactggtgctgatggccgcatcgagatggtttccaatgccgacaatgaccggaagtacccagcaccaaggggttacttcttcaagctcctaaaactgaacgcaccggagtggccttacaccatactgggcgctattgggtccatcctatctgggtttatcggcccaacatttgccattgtgatgagcaacatgatcgaagtgttctattaccggaaccccaacaaaatggagagcaagaccagggagtacgtgttcatttacattggcactgggctgtatgcggttgttgcatacctcgtccagcattatttcttcagcatcatgggcgaaaacctcaccaccagggtgcggaggatgatgcttgccgtgattttacggaacgatgtcggatggttcgatcaggaggagaacaattcaaaccttgttgctgctcgcctctccacggacgctgctgatgtgaagtcggccattgccgagcggatatcagttatcctgcagaacatgacgtccctccttgtgtccttcgtggtcggcttcatcattgaatggcgggtcgccctcctcattctcatcaccttccctctcctcgtcctcgccaactttgcccagcaactgtcgatgaagggcttcgcgggcgacacagccaaggcccacgccaagacgagcatgatcgccggggagggcgtcagcaacatccgcacggtggcggcgttcaacgcgcaggacaagatcctgtccctcttctgcagcgagctgcgcgtgccgcagatgcacagcctgcggcgcagccagatctcgggcgcgctcttcggcctctcccagctctcgctgtacgcctccgaggcgctcatcctctggttcggcgcgcacctcgtccgcacccacgtgtccaccttctccaaggtcatcaaggtgttcgtggtcctggtgatcaccgccaactccgtcgccgagaccgtgagcctggcgccggagatcgtccgcggcggcgagtccatccgctccgtgttcgccatcctcaacagccggacccgcatcgaccccgacgacccggacgcggagcaggtggagtcggtgcgcggtgagatcgacttccgtcacgtcgacttcgcgtacccgacgcgccccgacgtgatggtgttcaaggacttcagcctgcggatccgggccgggcagagccaggcgctggtcggggcgagcgggtctgggaagagcaccgtcatcgcgctcattgagcggttctacgacccgctcgccgggaaggtgatggtcgacggcaaggacatccggcggctgaacctcaagtccctgcgcctcaggatcgggttggtgcaacaggagcccg

SEQ ID NO: 40 - DNA, 797 bp, Saccharum
cttgtcgcgtcggcaagatgatcacgggcacggacttctaccacgtgatgacggccatggtgccgctgtacgtcgccatgatcctggcgtacggctccgtgaggtggtggcgcatcttcacgccggaccagtgctcggggatcaaccgcttcgtggcgctcttcgcggtgccgctgctctccttccacttcatctccaccaacaacccctacaccatgaacctccgcggcacgctcctccacgtcgccatcgtccaggccgcgctgccgcagggcattgtccccttcgtcttcgccaaggagtacggcgtgcaccctgacatcctcagcacggcagtcatcttcggcatgctcatcgcgctgcccatcacgctggtgtactacatcctcatggggctgtgaaaaagccagacaagctgttggttctcgcaggccagccacagctcagcgatgccggatggatggagcaggaaggagacagacgaggggacaagcgaactgcagcgactgcgcgtacgtgcagggcagggcaggcaggaggttaattcgtaggagtattagttcttaggtgtagagatcatgcatggaaggcgattagagcaaacaaaatgttttaggacacgagtttgaaggaggccatatgcaaaagccttgggatgacagtttgcaaagcatccggttgctaaggttatgaggttggtttgggtgtgttagggagttgttaatcatgtggagggctttccatggatagttgggctagccatgccttatgaaatggatgcattgtcactttgattg

SEQ ID NO: 41 - DNA, 1013 bp, Saccharum
catggacaaaggcttcttgtgtttgagtacattggaaatggaacactacatgatatactgcacttttctgatgggatgagcaagaaactcacatggaacacccgcgtaaggatagcgctaggcaccgctcgcgctttagagtacctgcatgaggtgtgcctaccccctgtggtacataggaccttcaagtcatctaacatcctgcttgatgaagagtacagtccacatctgtctgactgtgggcttgctgctttaacaccgaatcctgagagagaggtttccgctgaagtggttggctcttttggatatagcgcccctgagttcgccatgtcaggaacatacactgcaaagagcgacgtgtacagttttggagtggtgatgctagagctgttgacaggccgcaagccactagacagctccagagagaggtcagaacagtctcttgtcagatgggcaaccccgcagctccacgacatcgatctacttgccaagatggttgatccggcactggatgggttgtaccctgccaagtccctctcccgtttcgccgacataatcgcgatctgcgtccagtcggagccggagttccgcccggcgatgtcggaagtggtgcagcagctggtgcggctgatgcagagggcgagcatcatacggcggcaatcggacgatctgggctactcgtacagggtccccgaccgcgaagccgacgtcctctgaacttggttcagctatatgtgtatacaacaaagcgctgcactgcacagttgtatatttaaagaaaagatcaaacaaaagaaaagcagattggggctggctgaggcagcagcacctcagggtcaggttactttggagtagagtgctgctggatccttcacgttttattctgtgtcctctgttagtcaactgtaaatgacatttgacatggatagcgtttggagtgtaccaggactcttcgtgagctgtgagtgtcatgatgtaatgtatagtgtgcgctctttgcatgcaaaaaaaaa

SEQ ID NO: 42 - DNA, 2652 bp, Saccharum
ctcggaaacaaacgcttaagggtacatagcacgttgtccaaacagtgaagtatcacatagggactacatagtacagactcaggtctgttgataggcggtcaggcgatgcataatagtacacaaaaagggtccaggaatagagtaccaacaggccatgtcctctgggatggtctaacacaacatagagtagggaacactgcaggaaagagacgccatttttagaggtgtggccgatcttcagagggtcagtggaggtgccagctgtgatctgattcgaagctgcgggcgggtgagtaatcttcaatccgccatgcgtaggcctcctaaaggacttccctgtcatagcccatttcctcggctgtgtcgaaggatgcgacggagtcagctggagcgtcatggatcggatcggcaggcagaacattttcttcaaatggcggtgcctcggaatagttgtaggtcattttaataggagacgcagaggttgagctcttcattccatttcagactaatagtcttcttttattattcatgctttcaacttctgtgatatgctgaaaaatagttatagttagtagctacatgtatatgtgaaaaaaacatggtcaactttatctcatttcagtctacatggtttatagagatcaagaaatataatgtggctatttgtagtgcagagacaaattgggaggtttttgtggttgccattctgctcttgcaccttgcacattgggaacggaaaacaaagcaaaactggtgcatacctcagttactggaattaaaagagcatctcccatgaacctgtgggaaatagagagtagcgaggccacaatctagaactattttcccataagaaatagtagtataaatcaatataagtctgacataaccatgtaccaaaaaatggatggaatgagattttgagaagcattttttactttataaggcgggtattgagcaaaccctgagcaatatttaagtattttgatttcctaacaatcataccaacagtacttgatgcactcactgggaactggtacacaataattcagaaataataacagaaatagtactggcaggaaaccacacccaatagtacaggcgccattagagaacaggaaaacagaaataatagaataggaaccaaccaaccaaccaacttgcatggaaaccatgaggaacagaagaacgacaggggcatggacaaatccggtcacggaggcactacctccaccccgcacatgacaggcccatccttcaggaatttcacaaaccaaagacacagagtaaagaacaatgaaatcagacactcgatgcgcagccgctaagaacaaaaaaaacgtaagcaacttgatgaaatcagacacaccacaccacactgcaggcctaaaaagacaagaaggaaaacaaagcagctgagggaaaaagaagatgaatatccatatggcaaagttatatacaaggttgcaaagttatactccagattcccgtggcaggtttcacattagctaaaagtgaaattctatttcagatacaaaagtcatactcattgcaagaactatagaataagaatcaaagaaggaagccaatccatagctttattagttaagaaatctaaagaaaaaactgaccctgatattgcagttcaccaagtaataaattatttgctagcaagcccaactgcaaatacatcattggcaatggggtgtgctcagaaatagaacaaccaataaattgtgtgaagcacaaacatcattgacaatggacctatgctcattaacaaatggacagaatgtagcaactaaaataacgacacagtcatcacaaagccaatgaaaatagcaagattcatggaagaatgaaataactatataatcatcattgcacaaaattccattgtctcatctcagtgtaaaaaagttcatcattgcacaatccccaaacctcagtagataacccgaatgaaacaattattcatcactatacaaggaaggatatcagttctgcagatgatctgcacatagagcttgctcgccgcaacgaagcggggagggggggggggggccaagatcctcatagtgaggagagggagttgagggaaggagaggggaaaaggggagagagcgcacgccggagtttaggatttggcctgtctagcatggcagcgggcgacgatgcgcgcaacaccacaacagagcggagggaggcggagcacagggagcagacgcgtaggaggcactggccagcgccgcccttggccacctggcccccagtcctccaccatgccaccgccgtccttggcctccgacggcttcctgcctggtgctctgcacggatctgacgggaggaggggcggatccggccatggaggcaccggatccgccagatccgccggtgtgggcctcctccagcgaggaagaccgagcaggcaaagcctagatcaacgtccatccccaacgtcggcgagggagtggagagaggctgtgtcgatctagggtttaggtgagagcgccgtcgcctccgtcgcactgcccgcgtcaggagggagagaggaagagaaggagagagaggaggtggagaggggaggcgggggcgggggcgggggcgggagtggcggagccgccggcgttggcgccggcgcaactcgcgctctcc

SEQ ID NO: 43 - DNA, 981 bp, Saccharum
ccacgcgtccgagagaatccccaggcaaacaaacagggtatagtggagaggagacaggagaggtcgagaggaaggttgggttcggcttcggcgagagagaccatggctccgatgaagctgtacggggcggtgctgtcgtggaacgtgacgaggtgcgcgacggcgctggaggaggccggctccgactacgagatcgtgcccatcaacttcgccaccgctgagcacaagagccccgagcacctcgcccgcaacccgtttggtcaggttccagctttgcaagatggggacttgtacatcttcgaatcacgcgcaatctgcaagtatgctgctcgcaaaaacaaaccagagctgttgagggaaggaaaccttgaggagtcagcaatggtggatgtttggatggaggtggaggcaaaccagtacacctctgtactgaatcccatcctcttccaggtcctcatcagtccgatgcttgggggaaccaccgaccagaaagttgtcgatgagaaccttgagaagctgaagaaggtgctagaggtgtatgaggcacgtctgaccaagtccaagtatctggctggagacttcctcagcctcgctgacgttaaccatgtatctgtcaccctctgcctgcttgccacaccctacgcatctgtgctcgacgcttacccgcacgtgaaggcctggtggtctagtctgatggagaggccatctgtccagaaggtcgctgccatgatgaagccatctgcttgaaggggttgccctatcaatcggtgaatgagtttgttctgggtatttgcttgttcagtgatgtatcttctacgttgaaagtccagtgcttatgagtgagcatgcttgtaataaggtcttgaattgttctgaaatgagcattcccgtgctcatattgagaatataaactttgtgttaaggttcctcaggatcttgatgagttctcgtttgatggttgctgctgcagtgttcaggctc

SEQ ID NO: 44 - DNA, 1039 bp, Saccharum
tttttttttttttttttttttttttttttttttttttttaaccagaaaccagggttcaatttatttcattgcacagttccaaccaaactgctgctcagcagcagaaatgttcacaaacgcaaccagactgacataggactcacatttcttgaagaaaaacatagggactcaacgacgactcgatcaggacacgaccacgacatgcagataatctccatcggagggacagaagaaggcaccagacttgtgaaccctggaaggacagctgctcatggcccaggacttactggccaccacggagacggagcaccaggtggagagtggactccttctggatgttgtagtctgccagggtgcggccatcctccagctgcttgccggcgaagatgagacgctgctggtccggggggatgccctccttgtcctggatcttcgccttcacattgtcgatggtgtcagaggactccacctccagggtgatggtcttgccggtgagggtcttgacgaagatctgcataccaccgcgaaggcggagcaccaggtgaagggtggactccttctggatgttgtagtctgccagggtgcggccatcctcaagctgcttgccagcaaagataagacgctgctggtccggggggatgccctccttgtcctggatcttcgccttcacattgtcgatggtgtcagaggactccacctccagggtgatggtcttgccagtgagggtcttgacgaagatctgcatgccacccctgagcctgagcaccagatggagggtggattccttctggatgttgtagtcagcaagggtacggccgtcctcaagctgcttgccagcgaagatgagcctctgctgatccggaggaatgccttccttgtcctggatcttagccttgacgttgtcaatggtgtccgaggactcaacctcgagggtgatggtcttgccggtgagggtcttaacaaagatctgcatcttgggaggatcgcgaggattcgcttcgcttcgatgaatttctccgacgaagggatgggattaggg

SEQ ID NO: 45 - DNA, 2477 bp, Saccharum
gtacgggcccccctcgagttttttttttttttttttttttttatctatctacaggagatcatttatttgcattcccatgtaaaattagacatcttgcaggtaacacagagctgttcactcgagtaaactcacacagctctccaggagtaaaatgaaagaaaccaacacgagacaaaaccctagactgacagaagaaattacattgtaaatacctacagtggtgctgagcaatgctgccctcctctctggccatcagcaggcggcacaaatgggccctaatgtacaattacccaggagcaggcaggcaggtagaatatcacaagagagagtcatctcccagacatgaggttcaccagaccttggttctcctggatagcgttcatgtcccagaactcgctcgtcgatgagagcgtcatcagcgccacgactatggatctcattgtgggcctccccttggggtcttcctgcgtacacgcccttgccaggactgtcatcttgaggattgagtcgatggggtaatcctcgcctaacgccggatcaatcagtctttgaaggccttccttaggatcctgtgtgtttagagcctcctcaaacagataaaccaatccctttgaatcactggaagactcagttgatctgacaatagcgtctttggccgaaataagttcatagagaacaacgccaaaggcataaacatcgacctttggagaaacatcaccataccgagcatattcagggggcatgtaaccaaatgtgcccacaattccacgtgtgggtagtgatgtattaccaacttctgtgagttttgttaaaccaaaatctgcgacctttgcacggtagttcttgtctatcaagatatttgctgatttgatatcccgatgtatgtacactggaacagtatgttcatgaatgtactcaagacctcttgctgaatctagtgcaatctgaaccctggcagcccaagacagaggctcataaccagttccacgcaaatgttggcttaagttcccattctcgatgaactcgtagacaagaaacaaggaactttcggtgcaaaaaccaatcaagcgcaccagattcagatgatgaacatgtgtcaaaacctttaactcagcaaggaactcatgagaagcctgcatatccattttctttatggcagctttctcgtccctgagctcagcataatagacagcaccaaaaccaccttgcccgattttgttactcatgctaaatccctctgtagcattaaaaagttcttcatacgagaactctactgatttatcaacagtaattcctggaactccagaggcactatcagcttgactggttgacagggtagttttatccatggatgtagtagcaagttgggtagagtcttcagaagatggaagtagggcagccttgtttgcctttcttcgcctatagaacatgatatataacacgacacccaggaccaccaaaacagcaacaccaccaagaactcctcctactatagctcctacggaacctccatttcctggtgtgtttaaaggatggtaacttccattgcgatcttggacggggatgaaaacgagcccgctcgtagcggtgtccatgccggggttatacttgcgaagcagctccagctgcgacggcgaattgaagctgtagttagcggcgacagcgtcgagggtctggcccatgagcgggtaggtgaggaagaagccgtagtccggcgagatgctccggtccccgcaggtgcagttgaccatgacgttcaccgtggtgttggtgtcggggatgttgttggcggggtacgggttggtgcgggcgagccaggcctcggaggtgaggttgttgtagttctgggcgatgctgctgtaggtgtcgccggtgacaaccttgtgcgggaaggagccgccgaggtaggtggcggaggagctggggaacgtgtggcagccgcaggtgaaggagatgttgacgctctgccccgcctggatgtagtccaagttggtggtgccggggttgtagggcgccagcgtcttgtagtcgtcgatgccgaagaggctggcgatgtaggtgaggttctggttccggctgatgaggtaggagcccagcgcaacgcagccggcgttgaggcagccgtcccccgccgcacccgccgcggcagcggcgaggaggaggagccgcatgaggatgtgaggcggcgccatgtgtacggacggcgaggaggaggaggaggaggcaaccctagccgcggaagcgtgtagccattagaggaggaggagctttagctttaaccgtgttaatggtctcacattattggtctatagagaatcaaagtaaatttaccaatgaatcgcgaaatgctatggttcttccatatgatttctgaagttattcagaagtaattcgtcgagatcgtgcaccttttcttatttatcaaaaaaaaaatactaaaaatattctaaagtgcagccggatagatccaatctatt

SEQ ID NO: 46 - DNA, 2299 bp, Saccharum
aaaacaattaaggaagcatcatcatattcaaaggctgagtaaagctcagcatgagtttttaaccacaacctcaaagtcaactgctcaaacaactacactaaattcaagttcaacttctaccacgacagcacgacgacacgacaacttctaccaagcgacacgatcggcaaaagagcgaggaagcattacgcatctcggacccctcgatgcacagggccgctttagtcgacctcctcgatcttggggccagcgccgctgctgccgccggccggtgcgtcctcgtccatgcccgcggcgccgcccatgtccgcgccagcgccctggtacatcttggcgatgatggggttgcagatgctctccagctccttcatcttgtcctcgaactcgtccgcctccgcgagctggttgctgtccagccagctgatggcgccgtcgatggcgtcctcgatgcgcttcttgtcgtccgcgcccagcttggaggcgatcttgtcgtccttgatggtgttgcgcatgttgtacgcgtagttctccagcgagttcttggcgtccaccttcttcttgtgctcctcgtcctccgccttgtacttctccgcctcctgcaccatcttctcgatctcctccttgctcagccgccccttgtcattggtgatggtgatcttgttcttctgccccgtcgtcttgtcctccgcagacacgttcaggatgccgttggcgtcgatgtcgaagcacaccgtgatctggggcacgccgcggggcgccggcgggatgccggacagctcgaacttgccgaggaggttgttgtccttggtcctggcgcgctccccctcgtacacctggatcagcaccccgggctggttgtcggagtaggtggagaacacctgctccttcttcgtcggtatggtggtgttgcgagggatcagcacggtcatcacgccgccggccgtctccaggcccagggacagcggggtcacgtcgagcaggagcaggtcctgcaccttctcgttaccctcgccgctcaggatggcggcctggacagccgcgccgtacgccacggcctcgtcggggttgatgctcttgcagagctccttgccgttgaagaagtcctggagcagctgctgcaccttggggatgcgggtggagccgcccacgagcacgacgtcgtgcacgctgctcttgtccatcttggcgtctcggaggcacttctccacgggctccatgcacttgcggaagaggtccatgttgagctcctcgaaccgggcgcgggtgatggtggtgtagaagtcgatgccctcgtacagcgagtcgatctcgatggtggtctgcgcggtggacgacagcgtgcgcttggcccgctcgcaggccgtccgcagacgccgcagcgcgcgcgggttgccgctgatgtccttcttgtgcttgcgcttgaactcctgcacgaagtggttcaccatgcggttgtcgaagtcctccccacccagatgggtgtcaccggcggtagccttcacctcgaagatgccctcctcgatggtcaggagcgacacatcgaaggtaccaccaccgaggtcgaagatgagcacgttcttctcgccgctgctggtggccttcttgtcgagcccgtaggcaatggccgcggcggtgggctcgttgatgatacgcatcacgttgagcccagagatgacgccggcgtccttagtggcctgcctctgggagtcgttgaagtaggcaggcacggtgaccacggcgttcttgatggtggagccgaggtaggcctccgcgatctccttcatcttggtcagcaccatcgaggagatctcctcggcggagaactgcttctcctcgcccttgtagttgaccacgatcatcggcttgtcggcagggccagccacgaccttgaacggccatagcttcatatcactctgcacggacgggtccgagaacctcctaccaatcaaccgcttcgcgtcgaagacggtgttggtggggttcatggcgacctggttcttggcggcatcgccgatgagccgctcggtgtcggtgaaggcgacgtacgacggcgtggtgcggttcccctggtcgttggcgatgatctcgacgcggtcgtgctgccacacgccaacgcacgagtacgtcgtgcccagatcgatcccgatcgccggcccctcccccttggccatctcttcctcttctgcgaacgaaaaagactggctctactccttccttcgatccctccttccttcgatccctcgcaggtcgtgctgctggttgcagagagattggttcgtggaaactttttttttctcag

SEQ ID NO: 47 - DNA, 1444 bp, Saccharum
aaaaagaattccattgtataatatatacggtcgttttctgtttacgaatttccctcttttggtctcacatcccaccaccaacgaattttacaagtcccggcgcggcgcggcgagccggcgacgcggccggcggcgtctctctctcccactgccagatgcacgcatctagtagtgcgtcggcggcccgaagcagccgtgttcgtcgcagtgcacgggcgggcggtgcaggaaggcgaggcactggtcggtgggccgctggtcgggtcgtccggcgatgcagttctggcggtcgtcgacgcggcggatgtcgaggcaccgctgcggctcggtgcagaagtagttgtacgagtaggtgaagttcctgaggctgggcagcgcgcagacgccctcggggatatgcccccacagctcgttgtgcgcgacgtcgagctgctggagcgcgtgcagcccggccaaggactccggcagcatgccctggagctcgttgaagctgaggtccagcacggtgagctcacgtagccaccccacctcctgcgggatgcacgaccgcaggcccgcgttgaggacgacgagctcgttgagcgtgcccgccatccgcgccacgctcggcgggatgcacccgcgcaggcgcaggttggcgagcaccaccacggacgccggcgagttgccgaagttgtcggggagctcgaagtcgaagtggttgtcgttgaggaagatggcgtcgagctgcttgtcgaacagcgctgccggcacgggcccgcacaggctgttgaaccggaggtccacgtacttgatgtttggtaagcagaggatgtgctgcgggaagccgccggtcaggcggttgttgctgacgtccagctcgtggaggagccgcagcttggggagcgactcgggcaggccgccggcgaagcggttggagttgaggtggaggagagcgaggtcggtcagcaggccgagctcctccgggaacgtccccgccaggtcgccgtggttgaggtcgacgccggccacggtctgggagtgcgggtcgtccggcgccgttgtgcagtagacgccgaagtaggcgcacacgtccgggccgcaccagttctgggtgaggttcttggggtcctccgtgatcgcgtgcttgagtgcttgcagcgccacgtacgccttctgcagccgcgggttgttgtccgccgtctgcttcggctgctgctgcccggagacggccgccaccgccgaggagaggagcagggccgccaccgccaggaccaccgtcgacgccgccgccttcttcatcgtgcccgcggcggcggcggggcgcgctctgcctctggcgtgcattgccgtcgtcgttcgccgacgaatgaaccaactcggtttcttgctggcagccgcgtgtggtgtggtttggtttgtgcgcgttgggttgcctctggtttgcgtttgttgggacgcgtgg

SEQ ID NO: 48 - DNA, 1182 bp, Saccharum
gcacgagccaggacttgccaaaaggaatagcgagagagaataagatcattcaaacggtgatgagacaactcttgtttgctcttgatggacttcattcgacagggattgttcacagagatataaaacctcaaaatgtgatattttcagagggatcacgaaccttcaaaattattgatcttggagcagcagctgacttacgagtaggaattaactatattcctaaagagttccttttggatccaaggtatgctgcaccagagcaatatattatgagcacgcaaaccccatctgctccttctgttccagttgcaactactttgtctccagtcctgtggcagctgaatcttcctgacagatttgacatatatagcttggggctcatattcttacagatggcattcccttcactacgaactgacagcagcctcatacaatttaatcgccaactgaagagatgcgattatgacttacaagcttggaggaatctggtggaaccacgagcgactgctgagcttcggaggggctttgacatcatggatctagacaatggtattggatgggaactcctcacgtcgatggtccggtacaaagcacggcaaaggaccagtgctgagggcgcattggcacacccatacttcaaccgtgaggggctccttggcctctctgtcatgcaaaacgcacgactgcaactgttccgggcaacccagaaggactacagtgaggcagctcggtgggttatcggcctcatggcaaggtcaggaactgaagatgtgggaggctttacagaagcacagcttcaagagcttagggaaataaaaccaaagaaaggcagcgcccagcggaacgtgcttgcatccgtgctgcgcctgcagaagaagatcctgaaaacgatcaacgagagcatggacgagctcaccagccagcgcaaaagcatctggtggagccggtggatacccagggaggagtaggccgccgcccgccggcgcacctgtacattgtccacttctgctgtataaaacgtcgcccagtagcactggtgatggtatactacactatcctacttacttcgtatatagtacatgctgatgactggaggtgagttcatcataaatttgtctgaaaagatcggagtaacacgatgtataggtgtaaatattttgcattgaagcaccatgatttttg

SEQ ID NO: 49 - DNA, 691 bp, Saccharum
acccacgcgtccgcccgcccggctctcccttctcagggtccaggtccactgctccacttctgatccgctccacgcaagctcccttgttcccggctccccacgtccgcgtcgcgctcgcgcccaagcaagcgctagcaggatagcagcaaagcaagcctcccctgatggctctggtgccctcaggctcgggtgccggccaggtgatcgccgaggtggcgatgaacggcggcgccgacccgaacgcgaccaccgtgcgcgctaccgtcgtgcaggcgtccaccatcttccacgacacgcccgccactctcgataaagcagagagattgatagcagaggctgctgggtatggttcacagttggttgtctttccagaagcttttattggaggctatcctcgtggatccacatttggcttcgggatcagtattagtattattaacccaaaagacaagggaaaggaagcattccggaggtatcatgcagctgctatcgatgtgcctggtccagaggttacacgcttggctgctatggctggaaaatataaggttttcttggtcatgggggtgattgaaagggaaggttataccctgtattggtcggtgcttttctttgatcctcttggccgttacctgggtaagcaccgcaagctcatgcctacggcattagagagaattatatggggatttgggga

SEQ ID NO: 50 - DNA, 1625 bp, Saccharum
ccccagctcacgcactttggaaccggtgcattccgatctgagggtgcccccgatgggggtttggctgtgactgagcttgctacgtcttttgctgcagccaggtctctcgtttgtctatcaggtttccgggaggtcgatccagaatatctcccagcgatctaccctgtttgtgccaggctcacctcactaaacttcagctttgcaagcctaaccgctgcggaactcaagccagttattcgcaactgcaccaatcttcgcactttctgggtccttgatactgtgggtgatgaaggcctacgtgctgtggctgagacatgctctgatctccgtgagctcagagtttttcctttggatgcctctgaagattctgagggttcagtctcagatgttggtcttcaggcaatctcagaaggctgccggaagctagaatcaatcctctacttttgccagcggatgacaaatgaagcagtaattgctatgtcgaagaactgtcctgagcttgtagtgttccgcctctgtattatgggccgccaccgccctgaccggatcactggggatcccatggatgaaggttttggcgcaattgtgatgaactgcaagaaactcaccaggctttcagtctctggcctgcttactgataaagcctttgcatacattggtaaatatggtaagctaataaagactctgtctgttgcctttgctgggaatagtgacatgtccctccaatatgtattcgagggatgcactaagttgcagaagcttgaggtcagagatagccctttcagtgacagggggttgctctcaggaatgaactacttctacaatatgaggttcttatggatgaactcatgcaggctaactatgaggggctgtaaagatgtagctcagcaaatgcaaaatttggtggttgaagtaattaaggaccactatgaagatgaaggggaggctgagattgttgacaagttgtacttgtatcggtcactggcaggaccaaggaatgacgcaccgccatttgttaccctcttgtaggactgctattggaagaacagccctgctgtacccacgaacatgtttgttgtattattccgtatcaagttttcagagccaatgagggaagcttcctgcggatgattttcaagttgctgcaggagcactcgtgtaaatcaaataagaagctgcagattattctttcacttgatctggcatggccagcatacagagttggggcaattgaggagcacatccagagggagacatctgatggccacacgctaatcttacagtatagcaatgatgggtagtgactgattgcacactgactccagtcagcaggcttcggatggttcttggcactagtctccagctccttgtatcttgccatcttccgtttcatttttctgcccagaccaaggaatggaagtgctgcctaatgtccgaggcttcaatgctccaccggacatcacttatgttttagatgatccaaaactcagattccgctatttttttctcccttttttttcattgattttagcactcatgagttatttttgtagacgacctgtagaccattatcccatttcttcgtctccactctttgctatttttaatcaagaagctattggtgg

SEQ ID NO: 51 - DNA, 633 bp, Saccharum
ttcacccaaagattgctgattttggtttggccaagttgtgccctgccaaggagagcaagctttctatgaccggtgctagaggtacacctgggtttatagctcctgaagtgcattctcgaaccttcggggttgtttcaacaaaagcagatgtttatagttatggaatgatgttgctagagatggttggaggcagaaaaaatgttgaatcagtggctcaagagtcaagtgaaaagtattttccacattggatttatgaccactttggtcaagacgatggattacaagcatgtgaagtcacacttgataacgaaggaatcgccaaaaaaatgagtgtgattggcctgtggtgcatccaaatattaccgatgcatcgccctaccatagggaaggtgttggaaatgttcgagagaggtttagatgaactggacatgccaccaaggcaaaacttcagtcaaatatttgaagagccagtttacagtttgaatgcagaaagctcgatcatgattagtggtaccaaaacacaagtttctagtgaagtgctaaagatgaaggagataaacattgaattcaaaaatcttacgacgggtacctactctgtgaaataggtacctacaatgctggaattgggcattc

SEQ ID NO: 52 - DNA, 1539 bp, Saccharum
atacagcaaatcagattgggatgctgcaaacccaaaccaaaaccttcgcatctgaacggaatttattcagccacgcggatgatacatctctaaagccgaaataaaagcatagcaggggcattcctactgcgacttccattcactgtctacaaataatacaaagtcggcgtacaacagaaagagagaaaaaatccactggcacttaacttttaacatcttgtataaagatcgagaagcagcaacaaaatctccaaacaaaagaattgggagacgtacaggtcgggctcatggaacccatatctaaggacagaagatctacagaccctgatgctgcggaagagaggagcatcaacaccagtaagttaaggtcaccaccacaattacaaaaagtagtctggggttttgcgagttgtgtctggctcaatttgccgaggtgccgggtcgaattgaaggaagttctggtccatgttttccccgatttcaagaatagcagccatgttaccacatcggtaacaataatttggcgcactgaagactgtgactacattcttatcctggcaccaattaaatccttccattacaagttgatgggcccttgaaatgagagagagaccatttgtatggttgaactgctgcgcaatgtcttgcccaaatgtgtaacctgctcctcttggtgaaattccccatccacatcggtcatctgggtcagaccacaaaagatcacacatgggtccttcatgaggaacctcctgtatgcgatcaagagaacgaatgttatccaatgtgtccaatgacggagagagaccaccatgaagacagaagacctgattttctatgagagccgtgagaggcaaataatcaaacaagtctgtaaaatatttccatacatttgcatttccatattttcttaagcattcatcatagaagccatacacttgagtgatttgtctgctctcatgatttcctctaagtattgtaattctatctctgtaacggactttcaaagccactaacagagaaactgtttcaactgaatagtagccacgatcgacgtagtcgcccatgaagaggtagttggtgtcgggagcgtcgccgccgatgcggaagagctcgatgaggtcatagaactggccgtggatgtcgccgcagacggtgacggggcagcgcacgggctgcacgttccactcctccatgaggatggccttggcctgctcgcagagcgccttgacctccgcctcgggcaggtacttgcagtcgcgcagctgcgcgatctgccggtccagatccccgtgcgacggcatctcgtccgccgccccgctccccgcccgcccgcggcagaggttgggtcggtggggggcgagtccttctccggccggccggcgggcccgccggcggtcaggtcggggctagggtttgggggagatcggcaagaggcggggaggaggcggagctcatgcctccattttttggggggcacgctgctttgtttttgttttgcgaatgcgagatttttcctcggctcttctttctcgggacggg

SEQ ID NO: 53 - DNA, 1311 bp, Saccharum
gagcagctaaacagcgtatggtacatctttatttactcacttatatttatgtattgtcactgcatgctaagttgatccgtacaaggcaatctgcaattgtacagcgctatacaaacttattatacagagtggaatgcaacatcccttatcacacgcacgggttaggctcggcggcgccatatctgcagcacaaaggactcgacgccatgagtgagcagctgctgagctgcctgcaggagcgatcagtaggtgtcatcagcgtctgcctcttcgtcgtcgctctccagctctgctatctcggccagcagcgccgggtcgaccaccttggacatgtcaccgggggtcttggcctcctgaacgatccgcatgatctcgtccacggcctgcgccggctcggcggcatccgcgtccttgtagttggccttctccctctccgagatctccctcggcaggttcttcaggaaccacgggtgatgctttatctccgggatcgtgatcctctttgaaggatcggcaacgaatatttgagacagaaggcgtctgcagtctgaagacactctcacataatccgggatggagtattgcacgccaagaattctactgatcgttttccggaagttccttggatcctcaggatcttcaaatggatacgatcccacgagcatcacgtacagtgtgacaccacaggaccaaacgtctgctacctttccatcatactcttttctggaaagaacctcgggcgctatgtatgctggagttccaactgttgattttggtttggaatgcagcaaaccagactttgagtaaccaaagtcacaaattttcacgcgaggtgttggactcccatcaaggagggtattctcaagtttaagatcacggtgacaaatttccacagagtgacagtagctgactcctgatatcagctgctgaaagaaatacctggactcatcttcactgaatcgccctgctgtggtgattttctcaaatagctctccaccagcagcatattccatgacgatagcaagatgtgtgggtgttaaacaaacctccttgaaccgtacgatgttagggtgccggagcgactggtgattgatgatctccctctgcacattctcatcgatcttcttgcccctctcgatgtacttgacggcgacgagctccttggtccgcttgtccctgaccagcctcgccaccccgaagttgccggcccccagctcctttagcgcctcgtacctctcctccatcagcagttcagcagcggtcccgacctagaactcccaagaatggcgagttggcgacaccgaagaaaag

SEQ ID NO: 54 - DNA, 1517 bp, Saccharum
cgagccatcgaaaaccagaggcgatagacagagcagggaagagagcgagagaggggaaagggagtcggaggggagcagcagcctacagcggtcgtctagggcgctggtgaagtgggcctctgcgcggccggccatgcagcggtgctgctgcctgtatccaccgaaagaagtagaggaaggagagggagaagggaaggaagcttggccggcggagggagctttggccggtggcttcggcttcggcttcgagctctggtcgtgacgacgtggcagaagggcgagggtgcggacggcagacgaggacgaggcactgggtgagcagtgggcggcggagcggtacgctccggcgtggagaaggagaagatggaatgctgcggggcagcgtcggcggaggcaggagcgccatgctcctctgcaggcctcggtgacggcggctccgagcgggattggtggccgggacgagctatggcgtagctcgtcgcggggaaggaggaaggaagggaaggtggtctcaactccgacgagcagaggcgagctggacaacgctccggtggtgcctgactccggcggctaggcggcggcagtgtcgtccatggctctagcgcggcggccagtggtggctgggcggcggcagtgccgtccatggctccagcgcggtggccttcgacggctgagcggcggcagggccgtccattgctcagcgcggcggtgctcagctgtccgtgactacagcgagcgcggtggcctcgacaaacgtcgtccttggcaccgcagcttggcggacacggagcggcagcggcgttcggctttgtcgcggtgaaggcaggggcgccatgctcccttgcaggccttggcagcggcagctccgaactccgtgcttggtggcacccgtggcggaggagaggtgagccgggcggccttttataggcggagtaaggcggtggccatggcaaatatctcggcgtcgcgacaacggacaaaggctccggcggtcgcgtccgtggcggcatcgcggcctggtgcagcagctacttcggcggcggcctcatcccagctagcggaggcgagcgcggtggcgagtcgactccagcaagcgcagctgacgaccccggctgcggcgaacgtgaggcgcgagcgtcgggcggcagcgattccggcgcgacggaggcaggggcgcggtgctcccttgcaggcctcggcgtcggcggctccgagctccgagcttcttcgacgtgtcctcccgctcgaggtcggcctcctccacggcgcccacggcgagctcgctggtgccttttataggcgcgcggcaaggcggtggcgccccaaaatatctcggccacccttgaaggcggtggagcccgtgtcgtacggtcgcgggtgcgctgtcgacgggaaacacgggaaggagataagatcgccgggaacacgacgaatgagaaggtcggttcgcggaaaatatctccgaccatggctttcacgtgctcgggactgcagcgcggacacggagacgacgtggt

SEQ ID NO: 55 - DNA, 1062 bp, Saccharum
gatggaaacaggagggatttccccctactgtgcatttatttattaagaaaggagaaccagcatacagaaaagttcaagagacaaaaaaggaaaaaaagtaaataagcaaaattacaacagggcttctagccattgttacatggaatgaaattaaagtatgttgtatatatggaaggaaagtacttccttgctctgtgaataaccagagcaaactccaatgccatatattacacatatatgatagccggagcttgcattcacatgttcctcacccaacgctagttgcagtagtttctagcaggtatatgtagggggagagatggatgatgccatgcttgcaacaatggatacatcagcagcagagaagcaaaggaatcaggagaaaaaggtgaaaaagaaaccaaggtgtgtgacccgaaggatgcaaaaccgaacaggtagaggcaggcaggcatgccattagcagctcacgcaggagctagctagcactttactcgctgccctcgggcttgtaggcgatgaagctgacgcactgcgtctgcctgatgttgtcgaagccgaggatgcggacgtaggcgtccgggtaggacgcgatggcctcctgcagctccttgtacacctgcgacgcgtcggtgcagccgaacatgggcagcttccacatggtccagtaccggccgtcgtagtagcacggggaggtggagttctcgcggtacacgaagccttccttgctgaactcgaggcagggcacccagttgttgcgcagcaggtagtccacctgcttcagcagctgctcctgcgtcagcggcggcaggtacgacagcgtctcgaacttcttgttgccgtacgccggccacacctgcatgcaccggatccttccgccgttgctgactttggcgaggctggtggtggagcggcgggcgacggggaggctggcggtggacttgagcccctggaacggagcgacggcggtggcggacgaggccatcacggtgggcgccatggctggactagctagtaatagtagtgagctgagggagcttgctgccttgctttgctgcttat

SEQ ID NO: 56 - DNA, 1815 bp, Saccharum
ggcgcgtcgaagaaatgaatgtagcataacgttgctgattgttccaatatcaatttccataacatcaatatcaatcgcagttctgtcgaactgcgccgaggagcttagcagagctagctgaattttacattatatgcaaaagcaaatttggcagagttcgataaacaactgaacccatttttgtacaggagtacctactatagggatataggtaaacagcaaccgccgagccatgctttcgtcgtcgatgagcgaccaggtgatcattttgcatgcaggggctctaatcaccctggctgttgacggccttaatgccatgctgcgttttctcatgcgctgctcttcatgccatcatcagctgtgttgccagagaaagcccagtgcggcttggccagggtgcgcttcgtagccttcactgacagtgggctgtccttgcccatgaggcacgttccctgctgtacgttgcagatggggtagtcatgggggcagcagctgtagtgatcgtcacagcaggtggcgccctcgagcgggcagcagccccaggcgaagcagtacttgccatactcgtagatgcagcagcaggtggtgctctcagggcacgagtagtagttgtcacagacgctgggctctggggtgggagaaggcggggtcgggccagggttcggggggttggcgccctccttcagggggtacgatggttcaacggcgataccgcacttgccgctggacgccttgatgttgcgctccatcctgatgtaaccggactcgccccagctgctgccccatgagttcttaacgatccagtagtccttgccattctctgtgccatagccgacggccgtgacaccatggtccaacgctgttccgcactttccagtgaagatacccgagctgtagagctgaaatgcactgccaccagcctcaatagcaacactgacgggctggtttgcaactgccttctgcagactcttctcactgttcgctggtacatcttcatagctgtcgatagtaacaaccttcgcgtttttcttgttggcatcacaccggccatccgtgcccttgtaagggtaatcagactccgtgtcgattccaccattgttgatgatgaactcaaacgcatagtccatcagacctccattgcacccctggttgtatgaagtgtcacagtcaacaagctcctgctcagacaaggagatcaagtcgcccgtaacaatctggttgatgccttctacagctgctattgttgagaaagcccagcaactcccgcagctgccctggtccttgacctccgcgacggcacccttggtcctccaatcaacggactccggcagctccacgttgtcgtcggcgtggtacctggcgctgagcttcctctccctctgcggcttggtcctgacgccgaggtaggtggcgcggtactcctcgttggtgaggtcggcgaagcggttgaggccaaggcggaaggagtggacgcccgcgtcggcggcggcgttgtgctcgtcgatgtagcggaggttgtccctgaacacctggtaccgcctctcctcctcgccgatggcgttgtaggtccggccgtgcgccgccatccactccgcgtacatccgccgcgtctcctcctcgctccgctccccgtaggagatgatcgacatgtccgccgccgcggcgagcgacacgagcagcagcagcgccgccgccgccgccagcgacgtagtggaggcgcccatctccgccgcgctacaggaaggcgagcgagctagctaggtaggaagaggagggagcagatggatggatgagagcccgggaattccggaccgg

SEQ ID NO: 57 - DNA, 1951 bp, Saccharum
aatgccgagagcaagagcagaaaccaccgaattattattggcaaacacctgattgacattctcatatgactccctgcgaacaactaccaaaagaaaacctgataaacccaggaaggcaaccaaaccagagggcagggggcacttgtgagcctatcctgctgacgttgtagataaaatccatgagccaccatcatcataagtgtggcggtgcagtgccatggcaccctgcgccacgacaaagaaagacattggtacaggagggtcttgccgcgcatgtgaggcatctactccttgtacttcatgctctcaagcgtgaacccaggcatgtcgaaggagtcagcgaacttctccacctgggtcttgaggttctcaatgtccttgttgttcaccaggcccttgttgaagtccttgaggagcttgccgtactccttctggatgttcaggcagatggtcaccgcctggtggaggaactctccaatctgctcaaagtccttctccactagacccctcgaggtcattgctggcgcaccaatgcggacaccacccggagccaatgcactgctgtcaccaaagacagcattcttgttcaatgtgatgtggcaaaggtcacaaagcttttcaaccttgtttccagtcaagccaagagggcggagatcccagagaacaaggtggttctcagttccatcagtcaccatcttgtagcccttgctcatgagatagtttccaattgcaacagcattggccttcacttgctttgcatacaccttgaagccaggtgtcatagtttgctgcagagcaacagcaagtgcagcaatctggtggttgtgagggccaccttggagagatgggaacacagcaaagttgatcttgtcttcataatcatacacagcaccctcaggttggcccttcttggggggcttagggcctttcctgtagaagatcatgccagcccttggccctctgagagacttgtgtgtggtagtggtaaccacatcacaatattcaaaaggatttgcagcttcctgcgcggcgacgagcccgctgatgtgcgccatgtcgcagagcagcagggccccgaccttgtcggcgacggccctgagcctggcgtagtcccagtccctcgggtacgcgctgccaccgcagatgatgagcttggggcggaagtcaagtgccttctcctcgagcttctcgtagtcgatgtacccggtggtggcgctcaccttgtacggcaggctctcaaagtagatcgaggtggcggagatcttcttcccgccggccgtgtagtacccatgagtgaggtgtccgccggagggaaggtcgagccccatgatccggtcgtgcgggttgagcagcgcggtgtaggcggcgaagttggcgggggaacccgagtagggctgcacgttgacgccccaggacgcggcgtcgaggcggaaggcagcgagcgcgcgtgatcggcagaggttctcgatctcgtcgatgacgtcgttgccgccgtagtagcgggcgccgggcatgccctcagagtacttgttggtgagcggagagccgagcgcctccatgacggcgaaggaggtgaagttctcggaggcgatgagctcgatgccgcgacgctggcgccgcttctcgcgctccaggaggtcgtagatctccgggtcggcgccggcgagcggggttagcccccatgtggcgacggggtccatggcggctgcggcggcgtgggagggggtgacaggagtggcggaggcgaggagggggcgggggcggaggcggaggcggagggaaggacgggggagggaggagggggcgcggggatatatagcggtggtggacgggagaagggcgcgtgtgcacatgtggaaggtgggtgggtgggtggtggtggtgttggtggtgcggtgcggtgggtgcgagtgcggacgaggtgttcgacggaatgcgggggcggagatcg

SEQ ID NO: 58 - DNA, 1680 bp, Saccharum
gaaatcaaagagtgacaccttactttcatatatatatgtgaatattacaaatcggccttgaagtgagaacatacctcaggtacatgtttacgataatttaaagggaagtacctagccattgcagtgatttctgcaggctctggcacaatacatacatatagggtgaactaattccttttaagatgaaggagctatatgctggatatgtatagaggataactatactagtaggtcatatatataccaagaaactggaaacataaagcaaatcagaagagattaactgcagttctattttcggttttcatctgccacctggatgcatcagctgcgagaacacaacgcttggggtcagaccatctgaatccacacttgcgaggctccgtcctgccatgctcatagtcgatgatgatgtggtagtggttgtgtccgtcagtggttcatccgagtgaagcctggggatgataagtggcgatgtgtttgaagatgtcccgtcaatgacgctgctactgtcctccgcgctctcctgcagctggagtgcaaattcaaggttccagaggacatcggccatagatggtctgtcgatgctgtgatcagccacgcacttctctgcagtctccacgaacttcatgaaacattggggagagattttcacttgcagatgtgggtcgatgatctggccaaggatgcctttcttctggcagtgcagcgcccagtcggcaaggctcacttgctcctttggaagcgaggggctcagagcagggcgtgcacagaggacctcaaacatcacgactccaaatgagtagacatcagatttctcagtgagctgctgccgtcggaagtactcggggtcgaggtatccaaagcttcccttcacaaccgtgctcacatgagtgttatcgacgttcggaccagtctttgacagcccaaagtctgaaacattagcaaccaatttgtcatccagcaaaatgttggtggtcttgacatctctgtgtatgatggtatgcttcgcaccagtgtgcaggtaatgcagtccccgagccgcaccgatgcatatctcaagccgcttcttccaggacagtgctggcttcttggtgttgtacaagtgctccctaagagtcccattggccatgtaatcatacactagaatcatctcattcatatcatcacaatacccaatcagcgacacaaggtgacggtgtcggagctttgacaacatctcaatctcagtctggaactcgtggacaccctgctcagacgtcgggttaccacgcttgattgccaccattgtgccactatctatctctccaaggtacacatttccaaaaccacctttgccgaggagcgaggtttgatcaaaattattggtggctgtctggatttcaccaaatgagaagtggcggcaaagattagatggcaatgttgacgtacggctccctgtggttgttgtcttccctgaggtgtttgaccgtgacttgctgtaatcagtgagaggagtccactggccatcatcgggtttcccagattcctttgctaccttctttcttctgcagatgatgcacacaccaataaaggcaatgagtagcgcagcaaaaccaccaacagctccaccaatgattgctggcaccggcacagaatctttgtttctaacactaggtttcccattactaggttcaaaag

SEQ ID NO: 59 - DNA, 919 bp, Saccharum
ctcacacccctgagctgagctttgctccactccagctccaagcacacagtcgtggttagagctagagggccgtgaaaatgccgatcagcaggatcgccgtggggacccaccatgaggtgtaccacccgggcgccctcaaggcggcgatcgctgagttcatctgcacactcatcttcgtcttcgccggccagggctccggcatggccttcagcaagctgaccagcggcggcgcgacgaccccctcgggcctgatcgcggcggctctggcgcacgccttcgcgctgttcgtggcggtgtccgtgggcgccaacatctccggcgggcacgtgaacccggccgtgaccttcggcgcgttcgtgggcggcaacatcaccctgttccgcggcctcctgtactgggtggcgcagctgctgggctccacggtggcgtgcttcctgctccgcttctccacgggcgggctggccacgggcaccttcggcctcacgggcgtctccgtgtgggaggcgctggtgctggagatcgtgatgaccttcgggctggtgtacacggtgtacgccaccgccgtggaccccaagaagggcagcctgggcaccatcgcccccatcgccatcggcttcatcgtgggcgccaacatcctggtcggcggcgccttcaccggcgcgtccatgaaccccgccgtgtccttcggccccgcgctcgtcagctgggagtggggataccagtgggtgtactgggtcggccccctcatcggcgccggcatcgctggcgttatctagggcgtgtttggttacctgcatacgccgcggccaggctctacggatgcagctgctgagcgtttggttggctggttggaggttggggcctgtcccatgcggtgcaagattccctagtgagccaggctcaactcatacgccaaaaa

SEQ ID NO: 60 - DNA, 1759 bp, Saccharum
cggacgcgtgggcggacgcgtgggcggacgcgtgggcggacgcgtgggcaacggcacctccgtgggctccgcgctcgcggccaccgtgatgtacgacgccaacgtcctcaccgtcctgtccgaggtcctgtccgccgtcttctgcgaggtgatgaacggcaagcccgagtacaccgaccacctcacccacaagctcaagcaccacccggggtccatcgaggccgccgccatcatggagcacatcctggacggcagcgccttcatgaagcacgccaagaaggtgaacgagctggacccgctgctcaagcccaagcaggacaggtacgcgctccgcacgtcgccgcagtggctgggcccccagatcgaggtcatccgcgccgccaccaagtccatcgagcgcgaggtcaactccgtcaacgacaacccggtcatcgacgtccaccgtggcaaggcgctgcacggcggcaacttccagggcacgcccatcggcgtgtccatggacaacgctcgcctcgccatcgccaacatcggcaagctcatgttcgcgcagttctcggagctggtcaacgagttctacaacaacgggctgacctccaacctggccggcagccgcaaccccagcctggactacggcttcaagggcacggagatcgccatggcctcctactgctctgagctgcagtacctgggcaaccccatcaccaaccacgtccagagcgcggagcagcacaaccaggacgtcaactccctcggcctcgtctccgccaggaagaccgccgaggccatcgacatcctgaagctcatgtcgtccacctacatcgtggcgctgtgccaggccatcgacctgcgccacctcgaggagaacatcaagacgtcggtgaagaacacggtgacccaggtggcgaagaaggtgctgaccatgaacccctcgggcgacctctccagcgcgcgcttcagcgagaaggagctcatcaccgccatcgaccgcgagggcgtgttcacctacgcggaggacccggccagcggcagcctgccgctgatgcagaagctgcgctccgtgctggtggaccacgccctcagcagcggcgacgcggagcgggagccctccgtgttctccaagatcaccaagttcgaggaggagctccgcgcggtgctgccccgggaggtggaggccgcccgcgtcgccgtggccgagggcaccgcccccgtggcgaaccggatcgcggacagccggtcgttcccgctgtaccgcttcgtccgcgaggagctcggctgcgtgttcctgaccggcgagaagctcaagtcccccggcgaggagtgcaccaaggtgttcaacggcatcagccagggcaagctcgtcgaccccatgctcgagtgcctcaaggagtgggacggcaagccgctgcccatcaacgtcgtcaactaaagacgcatgccaggcgccgccatcatccgtgcatgggcggaggaggaggagaagaggaggaaaatacatgaaaaataaaaaaaaaactacgtgtacacgtgtatgtccagatcgtgccgtcgttcttcgtcgttgacttttggttgtattgatcgatgcgtatgtgtgcgtgtgtggcgttgttctttcttctttgtgtagctgtcctgccaccgcctgcgatgtgcatgccatggcgggcagcgttttctaagattctatatactgttgtattttggggtgaagtaaatcttacgtactcaattccttcttctaaagtatcctgtcctatac

SEQ ID NO: 61 - DNA, 3972 bp, Saccharum
catcaaagagttgaacaatgaagatagatggcaagtgcctgatcgatttgatcaggtcgtgtaggaacaaggttcaaatcgttcgttcgttaggatgcctcagctgcatacatcactgcacttccacttgacacctatttaaacggctcgtctcgccgctaccttatcctatttccatacttctgtcgctccatccccgtatgggtggagaacccgtcgctgtctcggctgtgctaccggaggctctagggaagtcggaggagagagcactcatcttggggtgggcttactacttatatgctttcagcagttatcctctccacacttggctacccagcgtttaccgtaggcacgataactggtacaccagaggtgcgtccttcccggtcctctcgtactagggaaaggtcctctcaatgctctaacgcccacaccggatatggaccgaactgtctcacgacgttctgaacccagctcacgtaccgcattaatgggcgaacagcccaacccttggaaccacctacagctccaggtggcgaagagccgacatcgaggtgccaaaccttcccgtcgatgtggactcttggggaagatcagcctgttatccctagagtaacttttatccgttgagcgacggcccttccactcggcaccgtcggatcactaaggccgactttcgtctctgctcgacgggtgagtcttgcagtcaagctcccttctgcctttgcactcgaggaccaatgtccgtctggcccgaggaaacctttgcacgcctccgttaccttttgggaggcctacgccccatagaaactgtctacctgagactgtcccttggcccgcgggtctgacacaaggttagaatccgagctcttccagagtggtatctcactgatggctcgggcccccccggaagggggccttcttcgccttccacctaagctgcgcaggaaaagcccaaagccaatcccagggaacagtaaagcttcatagggtctttctgtccaggtgcaggtagtccgcatcttcacagacatgtctatttcaccgagcctctctccgagacagtgcccagatcgttacgcctttcgtgcgggtcggaacttacccgacaaggaatttcgctaccttaggaccgttatagttacggccgccgttcaccggggcttcggtcgccggcttccctgtcatcagttcaccaacttccttgaccttccggcactgggcaggcgtcagcccccatacatggtcttacgactttgcggagacctgtgtttttggtaaacagtcgcccgggcctggtcactgcgacccccttttgcgagggggcaccccttctcccgaagttacggggctattttgccgagttccttagagagagttgtctcgcgcccctaggtattctctacctacccacctgtgtcggtttcgggtacaggtacccttttgttgaaggtcgttcgagcttttcctgggagtatggcatgggttacatacttcagcgccgtagcgcctggtatgagcctcgtggagaagcaatggctagtccacggggctcatacttcagcgctgcagcgcttggtactcggacctcggctcgaggcattttctctaccccttcttaccctgaaaaagcagggtcaccttgtgtccttaaacctataaccatctttcggctaacctagcctcctccgtccctccgtaccaacaaggggtagtacaggaatattgacctgttgtccatcgactacgcctttcggcctgatcttaggccctgactcaccctccgtggacgaaccttgcggaggaaaccttgggttttcggggcattggattctcaccaatgttttcgttactcaagccgacattctcgcttccgcttcgtcgacccccgctttcgcgtttgcttccctctaaggcggaacgctcccctaccgatgcattttgacatcccacagcttcggcagatcgcttagccccgttcatcttcagcgcaagggcgctcgatcagtgagctattacgcactctttaaagggtggctgcttctaggcaaacctcctggctgtctttgcacccccacctcctttatcactgagcggtcatttaggggccttagctggtgatccgggctgtttccctctcgacgatgaagcttatcccccatcgtctcactggccgaccttgacccctgttatttttgggtcatatctagtattcagagtttgcctcgatttggtaccgctcgcgcagcccgcaccgaaacagtgctttacccctagatgtccagtcaactgctgcgcctcaacgcatttcggggagaaccagctagctctgggttcgagtggcatttcacccctaaccacaactcatccgctgattcttcaacatcagtcggttcggacctctgcttagtttcatccaagcttcatcctggtcatggatagatcacccaggttcgggtccataagcagtgacaatcgccctatgaagactcgctttcgctacggctccggtgggttccattcccttaaccaagccactgcctatgagtcgccggctcattcttcaacaggcacgcggtcagagatcactttcccctcccactgcttgggagctcagcacggtttcacgttctatttcactacccactgggggttcttttcacctttccctcacggtactacttcgctatcggtcacccaggagtatttagccttgcaaggtggtccttgctgattcacacgggattccacgtgccccatgctactcgggtcagagcgtaagctagtgatgctttcggctactggactttagccatctagggtgcggcactcaaccgcttcgcctagcagcacaacgcttgtattgctctcccacaaccccgttttcacggtttaggctgctcccatttcgctcgccgctactacgggaatcgcttttgctttcttttcctctggctactaagatgtttcagttcgccaggttgtctcttgcctgctcatggattcagcaggcagttcaaaaggttgacctatttgggaatctccggatctatgcttattttcaactccccgaagcatttcgtcgcttgctacgcccttcctcgtctctgggtgcctaggtatccaccgcaagcctttcctcttttgaacctcgccattaacgttaaggctatgccatcctaaggtgctactaaatggaaggatcttatcaacgtccatgaatgcgaaatcatagatcgaactgacgaattggcaaccttcggtgctatcatagtatccgctaagttcacgggctggagataagcggactcgaaccgctgacatccgccacagggtaaaccaccgcctctcaggcctccccgacgggttctaccatagaggacaacgataggcaataactcccccccgaacacagcttacaactttcatcgtactgtgctctccaaagagcaactcttctcaaaatcccaaaacaaaaggtgctgagttggaatcccattctaaggattcttgtggttccggggaatccagctacaggagaaccaggaacggggagctctcccctttttccgcccgactctttgatcttaacttaagaatgctggttttaagaacgagtgattgcccttctccgacccttactgcccaaccggagagcggacggctaatgtgttccacttattgaacaggatctatggtcggtccgtgacccctggacgccgaaggcgtccttggggtgatctcgtagttcctacggggtggagacaatggggtcggtccatggattttccttccttttgccacatttcgctcaaagggttgaagggagatagtgcatcaagctattcgcaagggccaacttgatcctcttccccagggatcccagatgagggaagcctaggagagccgccgactccaactatcgtccatgtacgatccatactagatctgaccaactgcccatcctacctc

SEQ ID NO: 62 - DNA, 499 bp, Saccharum
ctttttgtggcaccacaccaccacaccattgctctggtgcccttttacactgcttgtcgttccccatcgggagtggcatcccacaaggagcccggcgtcgtcgcagaagccagccacccccggcccttctcgccagccggatgatcggatccgcagggacagcactaccgtactgagctccgtgcagatctgggagaggtaccatccgatccatggagctggtgacgggggcgatggggagcctgctgcccaagttgggcgagctgctcaaggaggagtacggtcttcagaagggcatgaagaagaagatcgaaaagctatcacgggagctcaggaccgtgcacgccgtcctccgcaagatcggcgacgtgccaccggaccagatcgacgagctggtcaggctctgggttcgcgatatcagagaggcatcctacgacatggaggacatcgtcgacgcgttcttggtgcgcgtcgtcgatttccccaaccaggagcccac

SEQ ID NO: 63 - DNA, 715 bp, Saccharum
gtgaaactgaataattctagtacatggatataaggctccttatagtttttcgccacggggccttctgttgcaagctccattgttggacaaagcatggtccatcgtctcgagcgagctccatcactcgtcatcgtcttcgtcctcctcgctaccctcgtcgtcatcctcatcattgacctccgacttggacttgtcggactcctcttcgtcttcctcctcttcctccttggcaggaggagccttcttagcagcagcggtgctctcgcccttgttgtaggcagcaatggccttgttatactctagcttgagcttattagctttggctacatagggagccttgtccgattcggtgagggatttccacctgtcgccggcagcttttcccaccgcagcaacagacttgttcttagggttcttctccttgaactccttgcggaattcctccatgaatacgaagaaagcgctgggagccctcttgggcttgttggggtccttgccggccttccccttcctgcccttggcggcgggcttctccgctcccttactcttcaccgccagcttggcatcggccttggcggcgcccttggatttggcccccttcatggcggattggagcggcgacacggagcgcagcggtcagatccgcgcggggcggagcgaatcccgctcgcggccggggctgcgggggtgggaggggaaaggggaagggaggcga

SEQ ID NO: 64 - DNA, 1049 bp, Saccharum
ggatcaatacttgcgacatcagaggttattcaataccgaaggtcctccacaattataacagaatgataaaagaaatctttacatgagactatgagaggtcttccatgcagtacccatatggccatatatatgggctggcatgcattacattggtacaagcttgtatttgtggcactcttgaatacacacacaagtgctttgtcacgatgccgttggcctaggcaacctctttgcaatttcctcaaacagttggtttatattatcagctgtcttggctgacgtctcaatgaaaaacatattgttcttctctgcgtaatcctgtgcatcgtgcgaggatacacttcgattatcatgtaggtcagccttattcccaaccaaaaccattacaataccaggactaccatgcttctgaagttcctttacccaatactgtgctttgctaaatgattccggactcgttatatcgtagacaacaattgcagcagcagctcctctgtagtaaagtggtgccaaggcagcatacctctcttgcccagcagtatcccaaatttcaaacttcactattgttgaatcttccaatgccaatgtttgtgataaaaaagatgcaccaacagttaccttggaagtaggatcaaactgaccacgaacaaagcgaagaactatacagcttttcccaacacctgagtctcccagcaataccagcttagcacgcaagtcctttgaatcagtggcaggagagctatcgttgctgatagtgttcaaccctccagtacttctagctggcacagaggaggagcaacccatagctcaatatgcccgccggcgtcgacggggctagcgcactgtggcacgagcgcggcaaccggcgggaagggggatcgggcctctgccctgcctccggctccggtaggtccgccgcagttttgtcctttctcgtcggtggtctgggctctgatgaatctcgttgtcgttgtgacgcatgcgcgcgacgcgttgctgctgctcggggtcgggaaagcaaaggcagggcgttgggggcgacggggcgt

SEQ ID NO: 65 - DNA, 2527 bp, Saccharum
tttttttttttttttttaacaccaaatataagagccaattcgatttgccagtcaacccaatctaggcatttgttgttacagagcaaaacatcatactttcgacccacagcaaatgtccatacaaatcaaaactttttttttgcgacaaatgaaaacttaaaacactttctagggaaagaaacagccgatgatatgctaagcacagcatctcacagttctgacctaggccttgatagcatacttcctcatggggaagtacttctcacgcttcttttccctctccgtcttcagagaaagctggtgcttggtcaggcggcggcggatggcacgggtcttcttggggcggaggtcgagggggagaagcttcttcttcttgtacgcctcccgcagcgccgacttctgcttctgcgagatcaccgtgagcacgcgcgcgatcgaggtgcgcaccaccttgatcttggagagcttgttgggtgcgccgccggtgaccttggctacgcggaggagggagagctcagacttgagctccttgagctgcgcctgcaggtccgtcttgctcttcccccggaggtcggcaactttgatccggcccatggagacggcgccggttgcgacggcgccggttatctctttgctttgttttgtttttaggtgagaatcacttctccattaacactaggagctgcttcaaccccgcacgcacgtcacatttcgctacagggtccgacaataatagcagagccctgatagatagttacgggtccgacaaatacagaagcgtaacagcaatgaccaggaaagaacgcaaaagaaaacacgagaagccaacacaatcccacagctaatctcgcctttctagttcccttccagcagcctcctgcatatgtatagctgcaggccacaccacttcgctcacttgtactcaaggatcatgttgttctctggggccaggccaacgcaggccctcatgatgttctccagcatcgccctttgctttgccagagcgttcaccaccggtgtgccaggcggaaccaggggtgccttggtgaggtagctcaggatggtggccaccgggtggaaggagtggaacttgtcctctccctcagcttttagctggatcctggtgctgagctcagccaggagcaccagatcaaggatgataggtgcggcgagtagtgagtcctcacaggtgttgtgcagcacgatggtgttcttgccgcccatgaagatctcggaggtgtactcatccatagccctcttactgtctcccacatacggcacatacttgatgacaacaacatgatcgggatgctcgccgggctcatagaggatagcattgcttgagaccatgtcatccaccacattgctcttggagatctccttggacctgaatgtttgaggggcagacaggttcatgccatcgttgtttcccaagtggttgtagctcacaattgaggtgggctttattccagcaccaacaaggaaatcaaccaagacagatttcatcttggtctgtccactcttgaagtcgtcaccaccaatcaagcagttgttcttaatagcaagatcgatcagcccaggcacaaaggtgttctgggggctcccattaatgaacggcaccccctccatgacacaggcaatggcatatagtgttgatggcgagatctctgcctcgttcttgtccacagatgccagcagattctccattgtgtcgttgagaccagtgcatacattgctgtacctttcggtgtttgcagtccacagcacaactatcttgtccactttgttcttctccttaaactccctgatatccttgatgatctgctccacctgttctttcttggtgcccttgatgacattgttggcacgagagccttggttagcagcgatgaagtccggatcatagataccaggaagtggtaccatggactccatgtagggcctgagctgcttctgcaggtcaatgtccagcaccttggccctggtcatggaatcagccaggttcatgttgctgatgtcccagcctccgaacacaaggtcgtctgggttcaccatgggaaggaggctcttgaacggcgcatagatctcctccccgttgtagctgccgactctgatggtggaggcctgggtgagggagccgaagtagtttgcttgctgcaccttgtccttggtcgcccatgagatcccctccctgttggcaatgaccccagccgtcagcgtggacccgttgttgcctccccaccccacaagcatcaccccgagtttggggacggcggtgctggtccggaagttgtacttgacggacttggggcggacgacccagcgggaggcgccgtccttgccctcgtgcaccagctccgtcgtgtcgtaccggtactccgactcgatctccgtcgggccataccgaacgtgggggctctcgacgcggaagctctcgatgaacatcttgcctttcctcccctctcgccgctctcctcgaatgggatgcgaagcgaggtagcgagcgagaggatgaaggaggctgctg

SEQ ID NO: 66 - DNA, 1789 bp, Saccharum
gtcgttcgacgatctgttattccgccaaagacaccaggatattttgttttacaacaacacagcggggagcacgaagagatgacgccaacgcaatgacagacgcacacgacaagcgcggccacgcacgcacagacaaggccacggatgccaaccacacaacgatcgccgccggcaaaacgcaaaacgagaaaaaaaaacaacttgggactgctcaaagctcagagccatgggcagagacacacttaagttgacgaatttgcctacttgcacttggcagctctagcaatggcactgcagtaagccttctctgtgcccaaatgctctcttcctgtctaaaagactgatgactaaccatagataggtagatggagactttgggacgattaccagcttctcctcctgatttctcctccccttcctagggtaaaagtatgggcgattgcctccgtcctcagctctgcaagcggcggctagaacttgttgttgtaccagaagatgcccttgcggttctcaggctcgacgtagatgcactccctggcttcgcgccaggtcgccttggcaacaggagtagggtcgaactggtagtactcgccgaggatgggcttgatcgccttggtggcctccatggcgtggtagtgcggcatggtggagaagaggtggtgcgcgacgtgcgtgtccgtgatgttgtggaacacgcggttgaggatgccgtagtcgcggtccatggtggccagcgcgccgcgcagccagtcccactcgctcgagtcgtagtgggggagcgccgggtgggtgtgctgcaggtaggtgatgagcaccagccaagcgttcacgatcagcagcggcacggcgtagacgcgcaccacccaccagaacccgaacgtcgccgccagcttgtatagcccaaacgacacggccatgacaccggcgtccgagatgaagatctgggcgcgctcccggtcgttgtagatcggaccgtaggggtcgaagtggcaggcgaagcgcgggtacgggcgtcccgacgcgttggtggccaggtacagtggccacccgagagtgagctgcacgacgatgtgcaccagccggccgacggggttgttgtacacgtacggggtgtaccacggcagcgcttccttcttctttggcacgaacacctcgtcgcgctccagggagccagtgttggagtggtggcgacggtggctgtacttccacgagaagtacggcaccatcagcgacgagtgcagcaccaagccaacgatgtcatccaggagctggtagtccgagaaggcgtggtggccgcactcgtgcgcgatgacccacacgccagtgcacacgcacccctgggcgatccagtagagcggccaggccacgtagtggagcgggcttgggagcgccggtatgatggccagcgcaaagtacaggagcgccgccgcaatgacgaggtcatggaccacgtaggagaaggacttcaacactgagcgctcgaagcagtgtggcgggatggccttcttgatctgacccaccgtgaacggcggcttctccaccggtgagcgctgcattgcagcaccgccggtagcacgggcgagctgctcctgcttctcccgctccttctcggtcatcctgccaccggcacccattttgctgagactgagaacgacggaacagctgcgtcggggcggagcagatcgggcggacaccgcgcctcgcctctctccccttttctcctgtcccggagaggtaaacgagtggtggtgtgttcaggatttgaaggggggaggagggaggagcctgg

SEQ ID NO: 67 - DNA, 873 bp, Saccharum
tcaagggtgatcgtctttccagtaagggtcttcacaaagatctgcatgcctcccctgaggcgcagcaccaagtggagggtgctctccttctgaatgttgtaatcagcaagagtacgcccgtcctcgagctgcttgccggcgaagatgagccgctgctggtccgggggaatgccctccttgtcctggatcttggccttgacgttgtcgatggtgtccgaggactccacctcaagggtgatagtcttgccagtcagggtcttcacgaagatctgcattccacccctgaggcggagcacaaggtggagggtgctctccttctggatgttgtagtcagcaagcgtgcgcccgtcctcgagctgcttgccggcaaagatgagacgctgctggtccgggggaatgccctccttgtcctggatcttggccttgacgttgtctatggtgtcagaagactccacctcgagggtgatagtcttgccagtcagggtcttcacgaagatctgcatgcctcccctgaggcggagcacaaggtggagggtgctctccttctggatgttgtagtcggcaagggtgcgcccgtcctcgagctgcttgccggcaaagatgagccgctgctggtcaggggggatgccctccttgtcctggatcttggccttgacgttgtcgatggtgtcagaagactccacctcgagggtgatagtcttgccggtcagggtcttcacaaagatctgcatcttgaagcggggatcgacgaggctcgcgaggagagacgaggggattggggatcggggttgcgtgtgtgctccgaacaacacgagagaagatgagggttggggaaagaagctagggatggggctggctatttataacggcggg

SEQ ID NO: 68 - DNA, 1143 bp, Saccharum
agagcatgaaactgcagctctagaaaatgtggaactgaaagatgatgtttcttctgctgaaaatgagcataacaaatcgagcccccttgttcatttggaggatccactagtacctttgaaggatgtagaacagcatggtctaactcctgcagaggactttgtatctaatacagaagatcaacaagaagccaaggatatcagcttgcaggtacaagctgtggattccatgaaagattcaagcaaattaccagatggaaccacagaggcttcaaccaatgatgatttagaactggatacttctgcagatgtagaaaagcatgatcaaccttccttgctggaaccaagattggagtctgtctcttccccagtactgtctgtcttggatgagtctgacggtaaaatgcaatgtggtgtttctgacaaggatgaggtaccacatgtggatgagaaaactgaaactactgttgacaaggtaactggaggttctgcaaattgcgaggatcctgtttgtaatgcatcaaggaaggaacccgacattcagtagagtcacccttgccttggagaagaggcagacgatacaataggtggaacagtatttccctgattcagatagttgtgaattatcatgtccgcacggtggtggtggtatcacggtatatgagggagctgagatgaaaggctcaccagagagccaaactaatgctcagaaagaagacatctattcagttgtctctgacacggatgaatgcattaagactcagaaagccacggagggagaaaattctactgaagattctggtctgcgggtgtctgagatgtacaaatgcaatgagatgccgaaggatgctccagcaagagcaaatcctgctgaagacgaagcttccctgaaagaatacatcggcatgcagacagagaacaaggcttctgcctctccatctcctgatgatccaaaggttagtgatgagaagaagctggcagaagaaaaccagaagctgaaagaacttctgcaaaagcttcttgcatccggcaatgatcagacgggggtcatcacagacctaagtgagaaggtcaaggcgctcgagcggaagctggcacgcaagaagaggccaaaggtgagggtgcacaggccgtccaggcatgcga

SEQ ID NO: 69 - DNA, 2391 bp, Saccharum
ctcatgataatagattaacagtcaggcagggaccttccctgacacaactaggctggagttcggttatactgatcaggtgtacacatctggcaaagccttacactgctaatgtccactaaattaacgatcaatacgaactacaaaacatttactactgtacatgctagtctataatcaagaacgatagcagatgccttcacaacacaagactcagggtaccagtaacactgagccacattcagaactcgcctgcacataggagctgctacagtgaactagcgacatcaaaagatggtgctgacaggattccacatgaaaagattcctaggatacagtacgaccatagcatactgatgctaggtagagattcttagaccatttgtccttcacatgttgactagggaaagcagttgtcctcagtgtctcttgggtttcatctgtaggtcgcctccttggtacacttaaaacaaaagcagcctgatcccaagttgcagcagttgcagttatccggtaaccactgtcccaccttttatgaattccctcactgggatacaagaaatccagttcaacaacctgatcagaaaacccagcattacgagacatgacaacagcccatctacttccagcagttgccatggaagttacatagaaaccatctcgccatttcttgtttatccatttgtaggggaaagtatcactaactttgtaggactgttgtgtgtaggctgtgcctttagacatcactaccaccgagctgccattgtttgccccagcaagcgcagttatatagtagttcctctcccattgctccattatccattctttgtgaaggaaatgtggtgtaagctcataaacttgggcagtgaaaccagttccagcatccatgattatagcccagagattggaacaagatgttatgcaactgataaacagtccatcgtcattccctttttcaatgtgctgtacaagccttgaatctgcaacattgtagtggtacctttgtttcattggccgtctaccattatagacacttatccactgtgttgcaggcattcccatcctgatcttcttctttggttgttcatctgcctcttcctctatcaataagcggcctctcttttggccaacttgatgtataagcttctgagcaccatcagtgttaattggtctgacatctggatttggacctactacactatcaaaaagcgatacacattttgcatagttgggttcttcgtcaaacttcaaattgaccacatactctacaaactctttgaagggttgtgggcaaaagcaacagagagactctggagaggtagccattttcttcttgcaaacaaggaagcctttgttttcaccctgataaccttgccaaggtagacggccccgtagaagaaagactagcgtgtatgctagagattctaaatcatccctcctgctacctattctcccaagatgtgcatgaacactagcatagcgaactgttcccctgaaaacatctggtcgctgatcatattcaacgtgttgccctgttgcactatccttccacttcgtagctaagccaagatcaacaaggaagagtttcttttcttcaggtgtcccaggagtccctagcaagaaattctctggtttgacatcgccatgaacatacccttttgaatgcattttctcaagtatggagattgattcaatagcaatacaagcaaccatctcaggtgacattgtgtgagagttattattccagacatcccaaagactgggtccgagcatatccataaccataacaaagtaatccccttggcgtcctttgtagtggactcggggaacaccatgaatgccaccgacagcgttgtaaactgcccactcataaggagggccatagtgacatcctttactggtcctatgctcaaacttcagtgccacctcaacagcacctggaccagtagctgacatgcggtggccaacatatacttggccaaaaccacctttcccgagcttcttctcgactctatactttggtgaactacccacctggaccgtgtcagggacaggggggctgccctcgtcatcggctatcagcttgtcggcgctgtccgcgtcgtccatcccacgctccccctcgtcgtcgccgccttcccctgcgacgacctccacaggtctgatctcctctcgctccctctcctccctcgtcaccctccgcttcttctccgccggcggtggtgccggtgccggtggtgccgccggcgagaggcctatgtagtcgagctcgagtgggggcgacatggggagcagcaggacatgaaccggagggtgggggaggtgaggagtggctgtttgtgtgggggtagccggtagggggagagtgggagtctgggagtggaacggaaggag

SEQ ID NO: 70 - DNA, 1210 bp, Saccharum
cgtggctcacacctcgatcgcagcagcaacaacctccactgccgcccgcaacgcaacccacccgagaggcgaggaggggaagaaagcggcggcggcaaaaggaccaggaaagcagccaagcaagcatcggtggtgcggtggccgcccgtagcacctccatcatggggaggtcgccgtgctgcgagaaggcgcacaccaacaagggcgcgtggaccaaggaggaggacgaccgcctcgtggcgtacatcaaggcgcacggcgaggggtgctggcgctcgctgcccaaggccgccggccttctgcgctgcggcaagagctgccgcctccggtggatcaactacctccggcccgacctcaagcgcggcaacttcacggaagaggaggacgagctcatcatcaagctccacagcctcctcggcaacaaatggtccctgatcgctgggaggctgccgggcaggacggacaacgagatcaagaactactggaacacgcacatccggaggaagctgctgagcagggggatcgacccggtgacccaccgccccatcaacgagcacacgtccaacataaccatatcgttcgaggcggcggcggcggctgcccgtgaccgtgaggagacgaagggcgccgtcttccggctggaggagcacaacaaggcggcggcgatcggccgcgatcatcagaaccaccaccccgccgccgagtggggccaggggaagccgctcaagtgccccgacctcaacctggacctctgcatcagcccgccggcgccgtgccaggaggagaccatggccatggtgatgaagccggtgaagcgggaggccgggctctgcttcagctgcagcctggggctccccaagagcgccgactgcaagtgcagcaacttcctcgggctcaggaccgccatgctcgacttcagaagcctcgagatgaaatgaacgcttctctctctctccctctgtaacttccccctcttcgttttgttttgtcaccgcacctggtggatggatgatatttggttagtttcgtaggtgaaaatacgtagtagtgagtgagtgaaagagagagaaggaaaaaaaagcgaggatttgtgccctgggtcttacctgctgctctctcttgttgctccattccattttgtctcctctttctttctctgtaatgaccatcaccaactgatcatgggcaataatacttgctgcttactaaa

SEQ ID NO: 71 - DNA, 1892 bp, Saccharum
aaagataaagtgtgttcacctcatacatctataagtcatgtttattctgaagtaacacatcatatcatagaacaaattgaagggggctaagcttgaagccatcaccctctaatgtatctcaatacctcattactacacgctactacagccttgattgtggtttccattccatccaacttcctgaccgtaaaataaactaaacaacacgccaataagctcatccacaacagccttcaagacggttgtttcatcgggcttactcgccatcaacaaatgaaccaaagaacttgcttgcaaaaccgactctgcaatggacacggatcatccgaaagagaagctatgtacaaggaaagccagcaccgtctggtgaaagttcaaaggccgcatcatgctgccgtgatgttgccgtccacctcaccatcgcacttccacacaacatccttcagttgggttgacagacttctgtagaacttttggaattccagagtatccccctttgccttcttgagctcaactacatgtagggatggggctatttgaaaaacctcggttgcaacatttagattgccttttctacctgctttcgggttctccatccgcatcttgtattttttcttctgaacatcaaagccaagcggctttgcagcttcttcaatctttgtgattatctcttttgggggacactgtgaggtgaatcttgtctctcttttatactcctcctttgcttcaaacaaattctccagattcagtgcctggtttagtgaaatcagttcgaatgcattcattgaggttggctgatcttcagtttcctctttcacatgctggtcttctgaatctccaaaagcagcatccacgtcatccaagctagtttgatatttctcgttaaaaacaggaggcttgtacccctttttgaaccaaggatcttccagtatctgagaaatcgtgatcctagttttaggattgggatcaagaattctggtaaccaggttcttggctccagccgaaaaccaagaggggcagttaaactgagcttctgaaatcttcttgtatagggcgatgatgttgtcatcctcgaaaggtaaatatccagcaagaagaacaaagaggattactccacaagaccagacatctgcagttgcgccatcatagcctccatcctcgatcacctccggggcaacataattgggggttccacatgttgtatgaagcagaccatcagccttcacttgctcggttaaagcacttaaaccaaagtcagaaactttgagatttccattaccatcaagcagcaaattctctagcttcaagtctctgtgatacactcctctactgtggcagtaatcaacggcattaatcagttgctggaagtatttgcgtgcttcgtcctccttcaaccttccattggtagcaatgatttcaaaaagctctccacctgtaacatattccagaacgatgaaaatttttgctttactacccatcacctcaaacagtcgaacaacattaggatgccttactaatttcatggtacaaatttcacgcttgatctgttcaaccaatctgtgcttctgaactttctccttgtcaaggattttgatagcaacaggttcatggttttcagtgttcctagcaaaccggacctttgcgaaggttccttccccaatggtgcgtccgagctcatacttcccaacacggcgcttcacctttggtgacaatgcggctctcttagcccgatacatctcgaacaaatgaaggttactatgaaccttcaaggtattcttcaaacaccttccagcgctgagcgcaggctgatcgccggcacttgcgaggagctccgactccgagctcgcaagagctcaaggagaagcgaggatgtactaggttgattggagtgg

SEQ ID NO: 72 - DNA, 2108 bp, Saccharum
taaaggggccgccctttttttttttttttttcttaacaagaaaacaattattattcataaataaaatgctttgacagacatttctccatacatatatgctcattgtggtagacgcagctgaccacctagagctgtatacttattcaaatttaaattgattcagcatgtgtcaacatagaacacatgcttacagacgacataattctcatactaatagcctggcttggctgcttcacagaataaccaaacgacaaccacgaaattgcaaccatataaaaaaaacaactcagaagcaaatcgaaaccagaagcccgtcttactcaatcaagcactccatccttctccacggcatccacttcctcccagcagagaagattagccagtttgcggtccttcacaggaggagcattctccatgttctcgccttcaaagcagtgtagaacagatttgggcgagctagcaacagcgtcttcagcagcacaaaagctctggtagatgaggagtccgcctccaggcagctcctgctccaccatgttgttgcagtcataaacctctgcaccgagttgctttccccatgacccagcttggccacgcccgccgaagatagtcacagcaacagaaaattccgaggggccaaagcagccaatgaccctcttaacaaggtcatcataagacagagcagtggcatcgaagcccataacctcatagctggcatagctgaaaccatcctcaggcgtcacgtggattgtggagaatgcagagccatgaatcgcattcatggagtagccacagggttcaaagtcaaaatcacagatctccatctcagggataatttcagagataccagagagcttcgtcatttccttggcacatgttgtgttaccatcagcattagtcttgaaaaagactgaagctttcttcttgtccagaccagtcatgcacatctcaaggttaaccattggttgttctgggtactcagtggcatagtagatgtgccacttctgtccaggtcttgctggatctccaatcacataagcattaccaccagatttcaggccaccaaagtagcggttaagtacagcaacttcctcagagaagctcctgtggggggctggctgtgcgccaggaaagatgaacgtcccacgggagtacttcacagcagcaagcggcatagacagctcttcagcaagctcaaggatccttggaatggtaagcaggagcttggtagtgccgcaggtcttgatcacaatcttcagaggatagataaacaggcttgactcagaaaggacataggagtcaaaatccttgttggagagctcggacacaattgtgcaccgtgcaagatctagaacagagtcaatctgggccctggagagggcacgcaaaccacgcccatgagggtcgataaagacagatgcctcagagaatgtgatctcaaggcgcttctcatagccctcaaacccgatagctgagaccgggggagcatcagcagcagaaagaacagccattggagcaggtgaatcagaacacaatgctggagatggaggagggaggagtgcagggagcaagactggggaactggtcgattatcaggaagcagcaggccagagggattggtcagaatagtgtcagaaaagaaatcctaaactactagaacgaggaaggcaaaagggatatcaggatggcttctttgcgcagttggagtaagcagcagactggaacttcttcacgcctccggcaggtcgaacgtcctcaatgctgtagccaaggggagcttcatacatcatggaacgactactgctagacttcttgccacccttagactccattagtacatcaaattcaaatcgacgaggctatgtgtggaacccccgattcccgagcgcgcacgcgtgatccggaacagatctcacgaatttccccccttcaccaccacccgacgcagcagaccccgggctgagacaagcaaaaccgattctctaccaagaactcggcgagttcctcggtctcgtcacctaatctcagcgagaagagcagcggcggcggcggctagggggagggaattctttggcaacacgcgtccgcccacgcgtccgcccacgcgtccg

SEQ ID NO: 73 - DNA, 683 bp, Saccharum
ctagcgggctgcttgacaagcattaaaatacagcacacaacagatgagtttaatgaagcactgcattgcaaggtttgaagtcctatagtagtttagatgtaaatataactttgacataaacttcatggtagaggcaggccgaccggtgaccatgtagagatcgattatgtggatgcttcgctctcaagacgaatcctcttggtaccaacctcgtcgctagccggcaccctattctccttcgcttccacagaacatctcttgtatggcttgaagcctgttcggcgcgatttcagcttcaggtgcgacagctcattgggaaaggaagcccttggctcatccattgtgtcgaggtcatgatcaatgcttgtggcgttcttgttgaggtcaactgccactgtggtcacttcatcttcctcctccttggcaacctcctttgagtcttctgcttgtgggggagaaaagctttgcggaagcttttctctactgaacagcgcatcgaaagccagacgaccctcttcggaaacttccttccatgaatcacttgtgcttccactgcttctaaatctgcggtggttagtgtcaccagctgaaaagttgttgctgcaggaggcttgcttcaccttctcattagcattgtcttccttctcaggaacattgtccgcatctacatcactacttgaagg

SEQ ID NO: 74 - DNA, 777 bp, Saccharum
agcgcgtcccagagagaggagagagagacagaagaacaacccttccgtgtctgcgtccagtgtgtccgctcctcaactcctcaagcggtagcgtgcgcgcgggagacggagatggcggcttcggaggcggcggcggcggcgacaccggtggcgccggcagaggggtcggtgatcgcgatccacagcctggacgagtggagcatccagatcgaggaggccaacagcgcaaagaagctggtggtgattgacttcactgcaacatggtgtccaccatgccgcaccatagctccaatctttgctgatatggccaagaagttcccaaatgttgttttcctgaaagttgatgttgatgaaatgaagaccattgctgagcaattcagtgtcgaggccatgccaacattcctgttcatgagggagggcgacgtgaaggacaggcttgttggcgcagcaaaggatgagctggcaaagaagcttgaactacagatggccgcccagtagaccagtcatgctgtaatgaagtagtattcgcctaaataagaagacgcctcaactctgaaagaactagtgcctctgtgatagtgctacgtatgagaactagtgcctctgtgatggtactaagtatgtagtattaacttatatccaactactatgttgtttagtttctggatactgatagcataatgccctgcttgatccagcttgtgcttttcataccatgtttcctctttcagctgaggtgctataatggtgaatgagagtcaatagcttggaaattgc

SEQ ID NO: 75 - DNA, 685 bp, Saccharum
atcactacctagtcagtagtcacctacactacaaagcttgtggcacgaagctaggttggtagaggcaatggcgtccaaggctgagctggtggtggaggtcaagtccccggcagacaagctgtgggcggcgctgcgcgactccacggagctgttccccaagatcttccccgagcagtacaagagcatcgagaccgtcgagggcgacggcaagtccgccggcaccgtccgcctcctcaagtacaccggggcggtgccgatgctgacgttcgccaaggagaagctggaggtggtggacgacgagaacaaggtggtgtcgtacagcgtggtggacggcgagctggtggacttctacaagaacttcaagatcacgctgaaggtggccccggccaacggcggcggcggagggcgaggccggcgccggcgccgtcgtcagctgggccatggagttcgacaaggccaacgaccaggtgcccgacccggacgtcatcaaggagaccgccgccaagacgttccacgacctcgacgactacctcctcaagaactagatggagatggtccaataatccagtttactactagtgctctagtgcacgtcgctggtgtggtgtggtgtggtgtgtgtcatgctggcctatttgctacctagctaccgcgggccgtgtccttgtctcaggctgatgttgct

SEQ ID NO: 76 - DNA, 917 bp, Saccharum
cgcgccgctcggtgctcggtgctctttctcccttgtactagcggtagcagcagtaacttctagatccatccatccttgtggctttgtgacttgtgagagctcgagagaaaggagcgagcagcgaccgaagaagatgctggagaagctgtgggacgacgtggtggccgggcctcacccggagacgggcctggagaagctccgcaaggccaccaccgcccgcccgctcgtcatcgacaaagaagcggatgccggagccgccgcggggagctacaagcggacgcagtcgatgccgtcgaccccgacgacgccggtgacgccgtcgtcgtcgacgacgacgccgcgcggcgccagcaacgtgtggcgcagcgtgttccacccggggagcaacctggccaccaagagcatcggcgccaacctcttcgaccgcccgcagcccaactcccccaccgtctacgactggctgtacagcgacgagaccaggagcaaccaccgttagatcggactgatgagatcggatgaggaggtggatgatgatgaagggcccggcggtctatgtcaggccatgtttgctggtccttgtggttatctaaaagtcgcatgcatgctctattatagtacttctgctttgctgttgctgataaacactttgccgtttaatttgtcctatatgttatgtcatgttatggagtgagagtgatatgcagtcgctcctagtagtgagtactgagtagttcctctgactcggcttggccagtgaagggagctctgtgtgtgtggtacgtgtggtgtgtgctagcttttctccatcttgtaaatattttgccagtgagtaatggatgcgtgtacttctacgtgccaaaaaaaaaaaaaaaaaaaaaaaaaaaaaaaaaaaaaaaaaaaaaaaaaaaaaaaaaaaa

SEQ ID NO: 77 - DNA, 1151 bp, Saccharum
atcctcttgtatctggcattacttgctgacctcaaaatggatcacaaaatagcccatcactaggggaattcaacagaatagagaacaatgaattgagatatgatgcataggattggatcatacagaatccaatcttggataaattaaagttactcttacatcttatcctaattctttttgcccaacagtttgacagacatagtagttcttgcggagggctactttcacagggaaatattttaggatccaaaaggagctgttcaatcaccagcttctgtacgccactatgaccatacttccactactaatgccttgccttttcctccctctgtcacgcattcatatcatcgcttcctctgtactcgccatttataaacaggctgtgatgtttgattatccgtctcctcatcttcattgagtttcagtttcctcttgcgtccaggtttcttcaattctttttgcaaggccatgtctgcatacaatttctcaagcttttgaagccgctgcttcctctcttctaactccctgtacgaagaggcagtttttttctttatacgagaagggatgttgtcaaaaccaggcatgttgctgctttgtcctatccttgattgtatttctttcgcttcttctctgtcttcagcaaaataaacatgcttgttttgaggcttgttatccagttcatgaagtgttgaccttaacttttcaattttctttttttcactttgaacgctctgaaggatatatcccatatctttattttttaacagaagaagctcctcttctgtatacttattatcttcaggcttaggtctatgaattccaccaacagtcctactgttgatcattttaaagtagaattcatccgggttcctaaatgctgccttctccttcagtttcgcgatggttgcctccttgatgtggtaagctcgcgcccggacgacatagtccttgtgtttctccaaaagcccaaacttcttcctcgcctccggctgggagcgctccttgtgagcgcgccgcgggatcgcattccgcagcgacgacatcttcccctcccgtctgctgcttccgctaccgtgattttgttggcctagtcttcgctgccgcggatgtcggaggagagagcagcgccgggaggaaaggggaaaagaaat

SEQ ID NO: 78 - DNA, 1262 bp, Saccharum
gatcaggttcaggttcaggttcaggttcaggttcgactcgtatgctgtatctatttacagagttcgcaaccttacaacgccgtcttctcctgatccatggctccatgcctccatccccgcctcagctcagaagggtcccaacccggcggctccgccgggctggttccccttgaccctgggcgacgcgaagagcgaggagtagaagtcctccccgggcggcggcagcatgtcgaggccgctgtacatgccctggatgtcgtcgtagctgaggtccacgaacaggtcgctgctcttggcggcgttggcggcggcgctgccgtcgtccacctgctccttcttgggtaccatcatcatcgctgccgctgggtcctggaacgccgggaacgagtccagctccgggaacgggtcgttgtccacgatctccgactccggcgtgcgcgtctcgccccacgagtgcgagtgggactgcgagtgggagtgcgagtgcgaggtggtcatgtccatcgcctcctccttggttgtgccgacgccggcggcggactccttccccagctgcatcttctcccactcgttcttcttgttgtacaggcggcacagcacccagtcatccagctgagcgatcccttcttggcggcggcggcgcggccggcgtccgcgagcctgtactcgtgcatgatccagtccgtcttgaccccgcgcggcgcctttccggcgtagaagacaagcgccttcttgatcccgagcgtgcgcccccgcggcgcgacgggcttgtcggcgccggtggccttccagtagccgttgccggcggcgcggttggggcgggacccgttggggtacttgcggtccctgggcgtgaagaagtaccactccctgaccccgaagagcgcgcgctccggcaggttccaggggtcgaacttgtagaggtccacctcggcgatgatggggaccgggaggcgctgccccgccgccttccggcacaggtagtgctccaccagctcgtcgtcggtggggtggaaccggaaccccggcggcaggttcagctccgcctccgcgtccctctccctcctcaccggcagtcccatggcttggtctggttgctggcgtggcgatgaatgaacccgacaggcggcggcaacaccgatcggtcggtcggtaaaagtggtggtgggtttggctgcctgcttcctttctccggcccgctgcgtaaaaatgctcgctccggcggctggcgctcgtcgatggtgggtggctcggctctgtgt

SEQ ID NO: 79 - DNA, 546 bp, Saccharum
ctcagtcacagcaactacaccgatcaccaaccagagcgcaaatcaaggcgcgttaggctccaacccaagaagcagatacatagatggccgctgcagcgaaggcgtcatggatggtggcgatgagcgtgggcgccgtggaggcgctcaaggaccaggcgggcctctgccgctggaactacgcgctgcggtccatccaccggaccgtcaaggccaacgcccccagcttcgcgcaggccaagaagctggcgccggcggagaagaggcgggcggacaaggccgaggaggggatgaggaccgtcatgtacctcagctgctggggccccaactagaactaggcttcagttttcagttcagccatctctgtctcggcttgcagtgcagcaagtcagcaaccgggaactgggcttgggttgagacctgtctggtcgcctcctgcgattgtaatataggatgatgatgaaaagttctttttacttcacacgagtatgcgaatggttctgctactgtatgttcagacttgcgtgggaattttaacaagaattcagt

SEQ ID NO: 80 - DNA, 491 bp, Saccharum
gttcccaagccattagttggtagcaagccaagctaagctaagctttagataccctcttcttcttcctcctccctccgaaggcagaggcagctgacggaatagcaagctagcttcggagttccgagcgcccagcaatggccattgccggtgctcttttcgtcctcgtcggtctcctcgcccgggaagccgcggccggcggctacggcgggtggcagagcgcgcacgccacgttctacggcggcggcgacgcgtccggcacaatgggcggcgcatgcgggtacggcaacctgtacagcaccgggtacggcacgaacacggcggcgctgagcacggcgctgttcaacgacagcgcggcgtgcgggtcctgctacgagctgcagtgcgacaacgcggggaggtcgtgcctgccgggcaccatcaccgtgacggccaccaacttctgcccgcccaactacggcctccccagcgacgacggcgggtggtgcaacccg

SEQ ID NO: 81 - DNA, 2092 bp, Saccharum
  misc_feature 44, 50, 57, 72: n = A,T,C or G
cctgtgggactgcctgcacgtttgcggtttgccatgtaaactantcggancgggcanagagaggccaggcanatcccccgccgccgccagtccccaaaacaaaaccctagctaggcatggccaccatccccaccacagattccggcctcctcctcggttcctccgctctcctccggaggaccagaagggccgcctcgtccgccaggcttcccgctgccgcccgccgtcgcccgcagctcctcgtgcgcgcctccgccaaggacatcgccttcgaccaggactccagagcctcccttcaggccggcgtcgagaagctcgccgccgcggtcggcgtcaccctcggacccagaggaaggaatgttgtcctggatgagtttggaacccccaaagtggtcaatgacggagttaccattgctcgcgctattgagctcgctgatcccatggagaacgctggtgctgcattgattcgtgaagttgctagcaagacgaatgactcagccggtgacggaaccacgaccgcctctgttctcgctagggagatcataaaattgggtatgttgagcattacttcaggggcaaatccagtgtcagttaagaagggcatcgataagactgttcagaaattggtggaggaacttgagaagaagtccaggccagtcaagggtagcggggatattaaagctgttgctgccatatcagctggaaatgatgaatttgttgggactatgattgctgaagctattgacaaggttggccctgatggtgtcctctcaatcgagtcatcatcatcatttgagacgacagttgaagttgaagaagggatggagctcgacagaggatatatctcccctcagtttgtcaccaatcctgaaaaatctactgttgagtttgaaaatgctcggattcttgtcactgatcagaagatatcatcgataaaagaaatcattcctctgttggagcagacaacacagttaagagcgccacttcttataattgcagaggatgtaagtggcgaggcgctggcaacattagtcgtaaacaagcttagaggaattctaaatgtggctgcaatcaaagctcctggttttggtgagaggcgtaaagctcttcttcaggacattgccattgttacaggtgctgaatatcaatccaaagatcttggtctactagttgagaatacaacagtggagcagcttggcatagctcggaaagttacaatctcaagttcctcgacgaccattatagccgatgctgctagcaaagatgatatccaggccagaattgctcagctgaaaagagagctttctcagacagactcggcctatgactctgagaagttggcagagagaattgcaaagctttctggtggagttgctgtgatcaaggttggagcctcaaccgaggcagagcttgaggaccgcaagctccgcatagaggacgcaaagaatgcaacttttgcagctatagaggaaggtattgttccaggaggtggtgcagcctatgttcatctatcaacattcgtatcgtctatcaaggagacgttggatgatcctgaagagcgccttggtgctgatatcattcagaaggctttggtggcacctgcagcgttgatagcgcataatgctggggtggaaggcgaggtgattgtggataaaatcagggaaagcgaatgggagtttggttataacgccatgacggacaagcatgagaacctggtggaggctggtgtgatcgaccccgccaaagttactaggtgcgccctgcagaacgccgcctcggtggctggaatggtgctgactacccaggcaatcgttgtggagaagccacagaaggctcctgcagctgcagcagcaccctagggttcgttcaccatgtaatgtaatacttactagtgaaaacagttttactaggcacggaacaggcacgagcgtgcaaaaaaagaaaaaattgtggtgatcattagagagacaagggagagaaaaccgataaactattttttttttgtcatgcgtgggcaagaataaattgaatcaatgtgggatccatgaggcgaattgctatgcgctgttttggttgctaaaaaaaaaaaaaa

SEQ ID NO: 82 - DNA, 3086 bp, Saccharum
gaacacaaattaacttcattattattggggaactgaagggagccttattataaaagtcttacacgatcgaacataactgtagcggcttccgtaaggagtatttggctatttgcacaataccgcgcaagtttggaccacacttcacggacgggtaaaacgctcagaactcgaaagtcagaactcagatggagatgctgtttggaatgcccttggcggtgatgccggcggcatcgcccttcttgtcggaggtgttggggtagagcagcgtgtaggggaacttggccggcccgttgcggttcttgagccgtgggtccgcgttcaaggtcatcacgcggctctcgatctcggtaagccgcgtgccgaaccgcctgaacgcctcctgcgccttggcgtccgacgtccactcaggcgtgtcgcgctggccgaggtacacctcgtcggaggagtggctcgacaggatctccagcagcgagatgccgacgagggcctggaactggctcgtgatggtgcgcacgaacaccttctccgggtttttccccagctccgcgtactcgtcgctgcccggcaccggcatcggcttccggctgacggacggacggttcgggaggtacccggcgtacgggtactgcccgaagttgacggccgcgtggagcgccgacgcgatccagatgatggtggtgcaggccttgacgagctccgccaccgtctgcatctcgggccaccaggccgcgtccttgaggtcggcgtgcccgacctcgcgcgcctccttccaccacgcctgcagctccacgtccgcctgcagcacgccgtcgttggggtagtagatggccaggtactccgtcacccactgctcgatggagtgccagacggccagcccgtccgacgcgtacgggtagtcctccaccagcagccgcaccttgtacgggctcgacgggtcggcaaccgccatgcctctcttgattaggtcgtcagggagagcctgctcggtgaagttccagttcttgtagatgacggctgacatctcgaacgcgtactggcgcgggaacacggtggtctcgaagatgccgccggcgttgacgagcatctggcgcgcgttggagttgatgttcatggtgtcgcggtagtgcggcagcagcagcttgtgcacggggtgcgtcacgctgagctgccggttggtcgcgatgacgaacggctccatcacggcgtgcgtgttgagccagtggctgatcagctggtgccagcagtagtcgttcacgttggcgtaggccttggcgaggtgccacacccacgcctccgcgccggtggtcgacgtgggcgtgtacacggtgctcttggcggtggtcaggccgtcccggagctcgggcaggctcagctcgatggccaccggcaccagcgtgccgtcgccgcgcaggaacagcagcgtcctggtggcgtagatgaagttgccctccaggctgttgattctgaccaggaacggcatgaagttgtcgtggtggtccaggatgtagagccggttgccgtccagcgcctgctgcacggtgaggccctcgagcttgttctcgaggtgcgcctccgtgacggtgctcgtgtggtcaccgtacttgctcgggtcaagactacttctgggagggaactccgtgaaaacacggccgggtagacttaattaattcatccatagtactagtctcaagttccaacgacttccaagcctgtcagttgaggaggatggatcgttccctcaccgtgagacgcttgacgatcatggggttgacgccggcgagaatctcccgtccaaactcctcatccgtcatccaacctgtcttgtcctctgcatagccagaataatcgagatggaattggtaaccatatttaacaactaaatcaaagacaagttccgcatcatttgcacgcagcgatgatcgacctttgatgatttgcggcatggggagtttgaggaggtagtcgccgccgacggggaggacatccttgacgagctcgagcgggaactgcttccgcaggtcctcgagggccggtattttgggcagctggatcccgccctcgtagagcttcatgatgtccttgaaggagtcgaactcgccgggcgacaggtcgacgtaggtgcggatcgccgggatgacggcgttcacgagcgccttgatcgcgtagccgtagaagtccgacttcttgatgtggccgaaacgctcgtcgcgcggcacgtagacgtcgccgtcgaccagcgtcagcctgctctcgctgctggggtcggttttggtgggcttccgcccggtgcggcagcggcgcgggtaggggagttccgtggtgccgccgaggacggggcgcgggttgccgctgtcaggcaggcccaggtcgttgtagacgtcgtagcggtagacgcggtcgtgctcctggtacgggccctgctggtcgtcgcccctcaggttccggagctcgtcgtcgcggtaaggcttcagcgccgccggcatctggctgggaaggtacgtgtcgttggcgaagaagacgcggttgtaacggtacttggactgcgggtagatccatgagttggcgacgaagacgatggtgccgtggccggggacgttgtcgatggtgatggtcttgaggaagaactcggacgcgtggttgttcttgacgatgatggcgcctggaatgccctgcttctccacctcccagtcgaaggtggcgcggaactggttgtcgccggacagaagcggcggcgggttcagcagccactgctccaggctcgcctccgcgcccaccttcccgcggttgccattgttcgggtcgacgacggtggagctgatgagctggcaggtgacgccgcggccgaggaactcgccgacgccgtcgatgatggagccggcgatgctggtgacgtccaagccgagcacggtcttgcgcacgagcaccacgttgcccttgaggcgcgcattcttgttgctgcccgtgatgtcgccgatgatggggatctttccgatgtttccgaacatcttcggttctactactggcagagctaactgcaactactagttcctgggagtggctagctgtggccttgtgggtatttgcta

SEQ ID NO: 83 - DNA, 2757 bp, Saccharum
ggcggaacaagcaaagatttatatttagaactgtgtttagccgagcatgtcacactccatacaaacccaccgaacaagcaaaaaatccatgcagtaacaagtaacaactgaaaccagtcacacttcgcaaagcataaaacacaatgtcacatggagacacattcggccatgctcgcaaccaacgcccttggacccagggaccagggcaagatcaggtgcacgaaccgggacgcctcttattctcgtcacgcacaagcacagtaacagacaatgctgagcaacatccactgctgcaaaggagattggtggtttattctgaggtaagtagccggggaagagtagcggtgacactctgggagggcaaccattgaatctgtttcttggagcttcagcttcagcttacgagcttccttggaaggagagccctatcgcctggcatctcatatgagcgccggaaggggtcggctgggccatgccacgccctggatcccacgggcaaggggcgcttgacagtgttcccatgggttcgatacttcaggtctgtagcgaacctctcggaacccaaacctgaaaccctgttggggcccattgacagctgagacagcttctcggcaaggtcaggtgcacgggggttctgatccttggcaaggtaattcccattgctccttactgctgctggtctggaccaagactgattcatcacgttcgcctttgtcaccttatggttagtctctgggagctggtgatccaactccaatttcctttgcacaccagctgctcttgctggagtgttattgctcaagtatgagtaattaactgttggcctcgcattgggtacagtccccatggagtatctcctaatgttcttctgatccacagctcctttagccccagctgatggtggcgttgctgcatatccggtggatttgaagcgaagtgaaggagggacatagaagcacgtctgaaagaagggatgctgcaaaacctccactgctgttggccttcttcgtgggtcccatgagcaaagccacgaaataaggctgattgcatcttcgcttgctaagggaaccacttccgaaagatgtacgctttcacactgagggaactgaaaacctatagatgctgctagctgcagtccttcaggccaagtgcgctgattcggagtgccaagaatgctacagattttgtagagttcatctggttcacttgagccaggaaaaagtggtcgcagcgaaaaaagctcagcgataatggcacccattgcccacatgtcaactgctgcattgtaaacagtagcctgtagaagaacttcaggggcacgataccaacgagtggacacatattccgtatacggtggctcagaagaaatttcacgagcaagcccaaaatccgctatcttgatgagctcctttgtaacaagcaaattttcaggcttaaggtcacggtgaaaatatccacgctgatgcatgtgactcagagcttgaaatatttgaaagcaccagtttcggatttcagtctctgagaagggcttccctctgctcttcatcagttgataaagactacattccatgtactcaaaaacaaagaacaacgtatcattctctcttatgacttctttgagcttcacaatgtttggatggttcatccttcgcagggacttcacttcgcggaggtttatgcactcttcccaagaataatattttttcttcatcttcttgatcgcaaccactccaccactttccttattggttgcacgccaaacactcccaaatgttccatcaccaacttccttgatgatcgtatacctctccattttattagctggtggtgcgcagaactgcccttatttcagaacagttgtatagtaacaaacaagactcatatatgtatcacaggagcgtctttggatgttacaacaccaaagtcactggagactcctctcaaagctatgtatgctattcccatgctttgcgcaacaaaatcttgaacacctctgctctgatgtcatgccatccaaagtgaaggctggtgaaaggtagcgtaaccaatacacaccgaactttggactgaccagaatgaaaacttacagcggtagggtagaagaaagctagcagagaacaaaaaccagaacctagagcttatatgtgacggcaaagctctaagcgttagattcaagtgtccagagatgtcttgatggtaacttttgccggccaattagcaccaagacaaagattaccgaaatgttgccagaaaaacagatccaccatgctcaaataagtgtgctacagctgcactgtaatcactaggcaactctaatgtctgacagcatgggaccaggcaaggcagttgctaagcgcggggtgatcctcaggtgcagttgacaaaagagatgaccaagaagtctccgtaaagacaaaatctccagccaagaacttcctcgagcagcgagatgtgggatacagaggaacttgcagcgtagggggtgtactccatatccttgctgaaaatgctataactccagcagagcacggtgatgaaacctgggagcctctcggcatacccgcgcgccaccgccgccgccgccgaagggtccgggggactttcgcaccgccgcctccagcgctgatggggtgggggaggaacgggtgggtgggtcaacaccgccgcgcgcgcggtgtggaagaggaggaggaggacgacgacgacgaggtgggggaacacggattggagaggtgggttgcttcgaggatttttctg

SEQ ID NO: 84 - DNA, 1156 bp, Saccharum
ggaatcccgggtcgacctacgcgtccgctcacacccctgagcttagcttagctccacttaagctccagctccaagcaagcagtcgtggttagagctagagggccgtgaaaatgccgatcagcaggatcgccgtggggacccaccatgaggtgtaccacccgggcgccctcaaggcggcgatcgctgagttcatctgcaccctcatcttcgtcttcgccggccagggctccggcatggccttcagcaagctgaccagcggcggcgcgacgaccccctcggggctgatcgcggcggctctggcgcacgccttcgcgctgttcgtggcggtgtccgtgggcgccaacatctccggcgggcacgtgaaccctgccgtgaccttcggcgcgttcgtgggcggcaacatcaccctgttccgcggcctcctgtactgggtggcgcagctgctgggctccacggtggcgtgcttcctgctccgcttctccacgggcgggctggccacgggcaccttcggcctcacgggcgtctccgtgtgggaggcgctggtgctggagatcgtgatgaccttcgggctggtgtacacggtgtacgccaccgccgtggaccccaagaagggcagcctgggcaccatcgcccccatcgccatcggcttcatcgtgggcgccaacatcctggtcggcggcgccttcaccggcgcgtccatgaaccccgccgtgtccttcggccccgcgctcgtcagctgggagtggggataccagtgggtgtactgggtcggccccctcatcggcgccggcatcgctggcgttatctacgagctgctcttcatctcccacacccacgagcagctccccaccaccgactactaagccggccggccggcggcggccaaacaagtttgggttccgtcctccgtctccgtgcgcagctagcagatcatcacagttctctcgatctccccctcgccgtttagtttctctctcgtgcacgtgcatgcatcgtcgaccatctcaagctgctgctgctgcgccggcgccgctcgcatcgtttgctttcttggaccgatcagtctgtaaccgtgaattccggacccgtttgcttctgtaaaatttgtgcatttgcctgagtattcaccgagtcccacgtagtagctctctataat

SEQ ID NO: 85 - DNA, 1031 bp, Saccharum
cccggtctcggctcgttctcgacctctcgtctcgctctcgcccgcccggccgaccccgcggaaccctagcctagcctcgccccgaccgcggaatccccccggccgccgcgaccgcgaccgcgacgatggactgcgccgtaggcggagaccccgtggaggacttcctcctcggcggcgccggcgacgacggggatctcgccatcttctgcgacggaggacttgggattgagggtgtcaatggagatgcttgtggatttgaccaatctaatttagggaaaaggggtagagatgaaccgtcttcatctggtccaaaatccaaagcttgtcgtgaaaaaatgaggagggacaagctgaatgacaggttcctggaattaagttcagttatgaatcctggtaaacaagcaaagttggataaagcaaacatcttgagtgatgcagcccgtatggtggcacaacttagaggtgaggcagaaaagcttaaggaatcaaatgagaagctgcgggagaatatcaaggacctgaaggaggagaagaatgagctccgtgaagagaaagtgagactgaaggtagaaaaggataggctggaacagcaagtcaaagctatgagtgtagctcctacaggatatgttccccatatccctcatccagcttcataccatcctgctgcttttactccatttgtgccaccacagcaagctccagcaaacaaaagtgctccgatccctgcaccattccctgggatggcaatgtggcagtggttgcctccaaccatcgtggacacaactcaagatccgaagctctggccgccaaatgcttaggggcagctaccttggaatgctgacgcatcgtgccatttcttccattgggtggaaaatcagagtgtcagttaggtccctggagaggaatcaagttcgcaactcgcgtcatgtttatgctgtaacagttgtttccagcagtcgttatcaacttactttgttctattgaagggtggtgcctgtaattaatatatgtatcttgaccctctagttggc

SEQ ID NO: 86 - DNA, 1248 bp, Saccharum
cataacataaaagattttttttcacattacagcggctgcatattacacaattgggtactgaattacaagtctgggggttcagataaaagcagagcgaacttgaagaagaacggaggaactccacgtaacattgtaggcattggaaacaaccatgaataagaataactccatcagaacgcaggttgcctcttgaatcggcatctgaaagcagcaccagcttaagacctgctcttgaatgggatggccctgatgatcacctggtggtagatggcagccagggcagcgccgatgaaggggccgacccagaagatccagtgatcagaccaggcatggtgctggttgtaaatgacggcggcgccaaggctccgcgctgggttgatgccggtgccggtgatggggatggtggccaggtggaccaggaacaccgcgaatccgattgggagcggggcaaggatcggcacatgggagtccctggcgttcctcttggcgtcggtggcggagaagacggtgtagacgaggatgaaggtgccgacgatctcagcgccgaggccgtcgcccttggtgtatccgggcgcgacgacgttggcgccgccgccgttgcccatgtacagcccctgctggaaccccttgacgacgccggcgccgcagatggcgcccaggcactgcatgatgatgtagaagacagccctggtgagcgacaacttcctagccaggaacagcccgaaggtcaccgccgggttgatgtgcccgccggagatgccggcggtgcagtagacgagggcgaagatcatgccgccaaaggaccaggcgatgccctggatgccgacggtggcgcacttggaggtggacttggagacgcccatgacggtgaggatggagatgtagaggaagaggaaggtggcgacgaactcggcgatgcccgcgcggtagaaggaccacgacttgagctccccgggctcgaagagcggcgccggcgggggctccttgtagtccttgtcgtcggtgccctgcgccgccgtgccgatgggctggcgctccgagaacttgttggcgcccaggcgcacgtcctcctccttcccttccatgtcgccggctattagctcgctccttgcagcagccgagcctggctagctagagctagaagaagaagctagttgctgaactgagctgaggtggtgtggtgcttgtgtcgcagcggggagtgaagagtcttatagtgagcagcagcatcaatggtgcggacgcgtg

SEQ ID NO: 87 - DNA, 1214 bp, Saccharum
aagacaatgtgtttattatgatacaaaatgtgtttattatgatacaaatgtttttacccttcatccctctggatgtccataaaaatttacttaagacgacgtgattattatgatacaacgacgtgattattatgatacaggatgaaaagaatgcagggcacaagacacgtccgtcatcatgcatttatatatgacaattatatgtacaacggcacttggacacactatttccaaccactgctaaacgcttcgcgtaatcgcgtgttcttctccaaccttcaattcaagcgtcactcagcaacgctccctgcaagactgagctgaaagtcttcttctggctggctggacacgcctgtaagagcgcgcaaacatcattcttctcgaggaacttctcaccgttcaccaggacgaggggaatgtattgcaggaccagcttcttgcactgctgaacatgaccttcgatcttattgcactccttgataagaatctgaattatctcaagctccgcatctggatctttcagtttggacataatttcatcaagcagatggtggcagaacacacatgtgctgttacttctcacaccggagaaaatagccgtgtccctgcacaggccatactgtttgcagaacgcttctggtttgatctcagtaatcttggcaaacaggagagttgcataagagtccatcaattcaacacacttctcttcaaaggagaatgacttagagcaagcgtcatgaaggaattccatgaccttatcttgtgtctgtttctcactgagataactgacagcttcactcatgaatttttcacaggttgagcatactggaccactactcttgagatggacaggaatcttggttgaagaaatctgttccttcaagattgagccatgatctgggagttcaacagcatcgttggcctgtgcagcagatacaagacgcctggcctctgcagcaggtccccaggcggcggcgagcagcaagaggagcgcgagacagaaaggcgctttggaacccatctgtatggtgaattcgcgatgctttccttgtcaacctgaaggtcgagatggaaccgatcaatcgaatccaatcgaatcgaggagcagcgaggacgcgggcggaactagaacttcaccgtgcccgcgtggttgttaatatgggcggcgggcgagcggcggtggcggcgtcgattcctgtccttgtcggctccgg

SEQ ID NO: 88 - DNA, 2493 bp, Saccharum
gcctcccctcctcccccttcccctttcttctcctccctccctccctcttgcccgcttctctctggactcgcccctccctccagtctcgtctcccaggtcatggcaaagctggaacacggggggaaatagcaagtgggagataaacaggaagagctaggtgaatactacaagtagcagtacaaagaagagagtcagtctgcccgtgactgcgagtgaattggttgggtgtggtgtttgttgaggtcacgatgatgggaggcgggctgatgatggatcagagcgtggtgttccctggcgtccacaacttcgtggatctcctgcagcagaacggcgacaagaacctgggctttgggtcgctgatgccgcagacgtcctctggcgaccagtgcgtgatgggggagggtgatcttgtggacccgccgccggagagcttcccggacgctggggaggacgacagcgacgatgacgttgaggacatcgaggagctggagcgccgcatgtggcgcgatcgcatgaagctgaagcggctcagggagctgcagcagagccgcggcaaggattccatggctggcggtgggggcctggctgacggctcgtccaagccaaggcagtcacaggagcaggcccggcgcaagaagatgtcgcgcgcgcaggatggcatcctcaagtacatgctcaagatgatggaggtgtgccgcgcacagggctttgtgtatgggatcattccggagaagggcaagccggtgagcggtgcctccgataacctccgtgcgtggtggaaggagaaggtccgcttcgaccgcaacggcccggccgccatcgccaagtatcaggctgacaacgccgtccctggcgctgagaacgagcttgcctcgggggccgccagccctcattccttgcaggagctgcaggacactacgctcggctcactgctctcagcactcatgcagcactgtgaccccccacagcggcgctaccccctggagaagggcgttcctccaccgtggtggcctaccggcgacgaggagtggtggccggaacttggcattcccaaggaccagggcccacccccttacaagaagcctcatgaccttaagaaggcctggaaggtgagcgtgcttaccgctgtcatcaagcacatgtcaccagacatagagaagatccggcgcctcgttcgtcagtccaagtgcctccaggacaagatgactgccaaggagatctcaacctggcttgcggtcgtcaagcaggaagaggagctgtacctgaagctgcaccccggcgcactgccaccggcatctactggtggcatcgccagtgccatatccttcaacaccagctcaagcgagtatgatgtggacatcattgatgagtgcaagggggatgaggccggcaaccagaagacagcagtcactgacccaaccgcgttcaaccttggtgctgctatcctaagtgacaagttcctcgtgcagacaccgatgaaggaggagactgcggacgtcgagttcatccagaagaggaacgcccccgctgctgctgagccagagctaatgctaaacaaccgagtgtacacctgcaacaacatccagtgcccgcgcaatgactacagctatggattccttgaccggaatgcccgcaacagccaccagtacacctgtaagtacaacgatccaatccctcagagcactgagaacaagccgccgccgccaccaccacagtcacaggccttccagccggccttcaaccaacccaatcaggcactgaacaatctggatttcagcctgcccatggacgggcagaggtccatcgcagagctgatgaacatgtacgacaacaacttcatgacgaacaagaacatgagcagtgacagcgtcgccatcatggagaggcctaatgccatgccccagaggatccagatggatgagggtttctttggacagggcaacggagtcttcgacgatgtcaatagcatgatgcagcaacaacagcaggcaccagtgcagcagcagcagcagcagttcttcatccgtgatgacacgccattcgtgagccagatgggcgacatcaccagcacatcggagttcaggttcggttctggtttcaacatgtctagcaccgtcgattatccaggcgcggcacagaagaacgacgggaccaattggttctactgaagaataaacttgtagggctgggaaaccttgttataagctttggatttctccatggtgctccatggttctcctaagttgtcaagtctataggtctttgtcatataggttttgcagtagctgcaagacggctggaacttggaactggtttatacttgtatgtccgtccagccataaacctcttatggaaacttaatgttattcctagttttaaattgttagttccaatgctgttcatatatatggctgttacaatgcttgtgcttgtttctgtatgtgatgttgtactacctgttatttggtgtctgaatgaagtgttttcttgagt

SEQ ID NO: 89 - DNA, 2176 bp, Saccharum
ggtacagcaaaaatgtattaaaaatcttgcggtgtttatattcatgacacacggaaatgtactttgtgtatccacattgcaatttgctagggccacacaaaaaaaaacaaaaaataccaaacactgatgatactgctagtcaacaagctatcacctagatctccggaggccagacagccacaacaaaaggaattaacatcttataacaactaaaaaacggaaagctcctatagtatggtccctgtacactattggtaatttacaaatgcagtaaagcacatctccatctactttggtgctatagggataccacaggacataagtacagtgacacttcgaacggcatatatgttcttgtcctcggatgatccccagctcccatatgcctataatttacacttgtttgcttcaaagtatggcccagtcctctcctacatcctgtccaagctacgtcaaccaaaggtctgtacaaaaatgcagctcgggttccaaattccaatatgccaaatagagctccactagtcgcaacctcctagcacaaagcactaactagatagctgccgatgactgtacacttctcaactgtcagaggggggatcatattaaagtacaatgcaggcaccaatctgtttccctagttgaccacaaatgtgcaatgacacatcaaaacacagtgctcaattacctagttcactcctggaaatctgatatggggtgtgccagtatagatcagccccaaactgacctatgcacccatgatttgctccaaggatacaagaaaattggtttctgaatgaatccattactcctgtggggaaaatcataaaatcccattcaatactctctggtagtaatcatattgccgagtgcgccaagcatccatgctgctactgatcagtgagagcaccagggatacgcattgctcttcagttagactcaagtggaacctcttcctcaaattttgtatagtgcgagggccacctttgaaacatggaaagccagaatcctgcaacatttccacaagaagtataatacgctctgcatgcttccgacaagtaaggaaaccttgaatgcatagcaccttgaagtaatcaaagaactcgctgggagttccctctgcatcagaatccatcacttcaaggagttcccttgttagcttaaatggtgcactctcaaagtttacccctccaggagagttagatagtatgaaaccaaaatcaatatgaataatatgtccttcctcatctattagaagattcccattgtggcgatctttcacctgaagtaggtagcacagaatggaatatccagccatactttcaacaaagtttctctgtgcaagtttgaaatttggagaattctcttcatacttggctacatagtagtctcggagacttgaaatattgggaaacctacttttgagggaatggattgatgccgtatcagggatggtctcaattagtgctgtataagcagaagtaacaatcacttcataaggccgcagccatagtggtaaaccagcttcttgatatatatcatagaagtgtgcaacaagctgtacggccaagtgttcttgacggcagtcatcaccactcttgacaataatagaacgcaagtcccagccaggtgattttccatgaaccgaagaccgtcgaattctctctcgtttgacagcccaaagctcaccagccaaagcatcagttggttttggatccccaccatcagtagccttaggatctaaattttgggtgctctgcccaactccttttagaggaagaccaggtggagcttctccttttaatgctgcagactttacttcctcaatggcaattgtactaggaacgcggcgatggtccttctttcgtgttggttcattatcatctacatcttccatgttaactcctggaactgcagacaatgtaaccttcacccattcaataggctgatcagcaactgtttgcgaatctccaggtggatcatgagaatccgtagcatcatgtcgcagcctacgccccgtttcagaaagtgcaatgctccttgagcgaccaagtttctcaatagagaaactaacatttacaaattttactttagtctcccagagttgagccatcgcttggtcaataacctgagatgtagacttcagcattctgtctgtttcatagttttgtgtttcgtg

SEQ ID NO: 90 - DNA, 2192 bp, Saccharum
  misc_feature 1051, 1059: n = A,T,C or G
cccacgcgtccgcggacgcgtgggctgcttgccgcgggctcctctcgctcatccaccaagctccccgcgccgagatgtccgacggcaacgagtttgcagagctgctatgggagaacgggcaggcggtggtgcacgggaggaggaagcagccccaggccgccttcccgcccttcacttgcggcgctgccagcagcagcagagctcaagaaaagcagccaggtaccgacccggtggcgctgttgaagacgggaggcctcttcggcgacttctctcccggcctagacgccacccgtgacaacggtgatcttgatgacagcgtaccctggatccactaccccatcgtcgaagaagacagcgccgcacctgccctcgcagagagctacagcccagatttcttctcggagctccatgcagcggcagttgcagcggcggcggcgacggcgaacctcagccctctgccaccaccagtccagcacaccggcaacaacagaagcaccccggttgccaccaccagcagaggaccagaaccctcaaaggaaacccaccgcataccagtaccaggtccagccagcaggcctgagccacaagctgagttcgcggccaccaggaaacctcggccggagagcggcggagagggcttgatgaatttctccctcttctctaggccagcagccatggcgcgagcaagcctgcagaggccaccacagacaggcacagacaaggcgtccaatgtcaccacgagcacccgagtggagtcgatggttctacagttggccagtggaccaagaactgcccctgtgttcacggaccagaggatgccgtggtcacaatccaaggaggtgcggttttcatgcgcagcagcaccgacggctggtaacctgcagcaagagatgccccgggacatgactccgcagaaaaaagttgagaccagaaaggcttctgaggtcgcagtcgctacttcatcggtctgctccggcaatggtgctggaatacgaaatgacgagtcctggcgcctacaaaagaggaagagtcagaccgagtgttctgcaantcaaaatnatgatcttgatgatgagtccggtgggatgcaaagatcaggcagcagaggtacgaagcgcagccgcaccgcggaggtgcacaatttgtccgaaaggaggagaagggacaggatcaatgaaaaaatgcgcgccctccaagagctcatccccaactgcaacaagattgacaaagcctccatgctggatgaagcgattgagtacctcaaaaccctccagcttcaagttcagatgatgtccatgggaagtggactgtgcattcctcccatgctgctgccaccaaccatgcagcacttgcaaattcctccaattgctcatttccctcatctcggcatgggattgggttatgggatgggtgtcctcgatatgaacaacacagcagcggttccatttccgcccatgcctggtgctcacttcccttgttcaatgatcccaggcacgccaccacaaggtcttggaatgcctggcagaaacatgatgccgatgtttggagtccctgggcaagcaatccatccctcagcatctagcatacagccattcccatctttggcgggtcttcctgttaggcaaaacctggcacctcaggtttcagccgtcatggctaacatggcgcaggagcaacagcaaggcgtagcgactcagcagcagcagagcctgaataatgaagctcaacagggagcaaatacaggagatcctcaattgcagactatcgtgcaggctgagaaccagcattttagtgtgccctcttcagcacaaaccgaaagcaatcagtttttggatggtggtgacaacaggactcatactgcaggaagaaatgaagctgaaacataaaaacagtcagcaagtgcgagtctcgactaacaagctctgcagatgtgaatatcagcaccaactcatcctggacgagcttaacgagtttcaagatccacgaagcagatctatcacttgaaaagagtccaatcaatcaagacggatttggtgggctttagcgagctaagatgctccaaagttttgtgtaaaatgtaggtggtacatggaacctggtcacaagaaacatttcttgacagccagtgcagttttctaggttgtttttgctttcactaaagttttcttggatcaatatatcatattttcgca

SEQ ID NO: 91 - DNA, 1314 bp, Saccharum
cgccgagagagagagagagagagagaggtgtccatcgctgcctgccgagagacggatgaagaagtgcccatcggagctggagctggaggccttcctccgctgccgggaggacgccacggcggcggcggtggcggcgggcgtgcagaagcctgtgcacgacgtcgttgcgctggcgccgttcgccgccggtggcgtgttctcccctagccatctgtccgccttcagcttcgctgactcgaacactctcaatggaagcattcataatcacctatggtcccataaccacaacgtgaggcatcctgcagtctccacaacaatcgagtctcaatcatcaatctgtgcagcagcaagtccaacatcagctaccctgaaagaaagccaaactttgggtggcacaagtggttcagactccgatagtgaatcgctgtttgatatcgagggtggtccatgcgaacaaagcacaaacccacaggacgtgaagagaatgcgacggatggtgtcgaaccgtgagtctgctcgacggtcgaggaagaggaagcaagcccatttagctgaccttgagacacaggttgaccagctgcgaggcgaaaatgcatcgctctttaagcagctgacagatgccaaccagcaattcacaaccgcagtcacggaccacaggatcctgaaatcagatgtggaggccctcagagtcaaggtgaagctggcggaggacatggtggcccgtggcgcgctgtcgtgcgggctgggcagcctggggctgtcgccggtgctgaacccgcggcaggcgtgccgtggccccgacgtgctgtccggcctggacttccccggcgacgacgcgtgcttcacggggctgtcccccacggagcagctccagaactcgcccctgcagagcatcgccagcctcgagagcctggagaaccggatggttagcgaggtgacgagctgcggcggccccggcgtcgacgtctggccgtgggatcactccaacggcggtctgtccaagtgaagaaagccgaagcgtgggattcgcacgccgatggcaatggcaactatcctgtcctgtcctactgtatgcgtatcgatatgcgtggcgctatgaactgccatttctgtgttagctggagtggtgaactgaacggacttgagtttttcagagtccctcgtctccgtcggtatattgccttagttctgtaatagaactgactagttaaactttatactatatatatatgctgagagactgaactcgaagcataattatgctcaaaaaaaaaaaaaaaaaaaaaaaaaaaaaggggagcgcggacgcgtggg

SEQ ID NO: 92 - DNA, 903 bp, Saccharum
cgcacgcataccagacaccacaaacgagggacccggggcggggcaagagagagaaaaaaaaagagagaagacgtctctctcctctcgccgtccccgttccccaacctctcgtctgctcgcctgcaaaaggagtttgtcatggcatcgaagcgtatcctcaaggagctgaaggacctgcagaaagatccccccacatcatgcagtgccggtcctgctggtgaggacatgtttcattggcaagcaacaattatgggaccacctgacagtccctatgctggcggtgttttcttagtgaacattcatttcccgccggattaccccttcaaacctccaaaggtttctttcaagacaaaggtcttccatcctaatatcaacagcaatggaagtatatgccttgacattctcaaagagcagtggagccctgctttgacaatttctaaggtcctgctctccatctgttccctgctgactgaccccaacccggacgaccctcttgtccctgagattgcccacatgtacaagacggaccggccgaaatatgagtcaacagctcgcagctggacgcagaaatatgcgatgggctgacgaatacctcctgcccatcccccgacggttctcgtgtcgtctcaagaaatcgttgttgggcgccattgtttccttggatttgtttctggtcgtgtgtatccctgatccatctaggatcgtattgtagtcgacgtcggcctaccatcattgccatccatagtgaggtggttggacatgctttgcctatgcacctatgcttgctgggagaccttcctttgggtcggtgctatttggtaaatgttcatcgaagacattgattccgttgcctctggcgctttgcatgcccatgtgaatcattttgaatgtaggctgttcctt

SEQ ID NO: 93 - DNA, 765 bp, Saccharum
aagtatgtagataatgcatgtatatatacgttacatacatgcgtgtggacgattcacgatcatctcttattcatcaacttgttatatatttcccacccgtgcatataaacgtgtatggtggccaatacgcagcactaggcactatcgttcgaccaccgtgccgtccctttcgtgcccctcacgggcagaacgtcaccttgtagttgctgttgccacggcagccatgggtcttcttgtcatcggtcgggtagaggtacgcgtcggggcagcgaggggcaccgcagtgcaggttcacgccagtgctgcaggagaagtccatgggcaggttgtagccgtcgatcaccgagatgtcgtagtagtcgttgttggtgccgccggtgttgccgatggtgaactcggccagcgtcaggggcggctgcccagacagggtgcagtggagggcacccccgcaatcgcctgtctggcagtgcccacggccgccgctgttgaaggagcagccggtgcggccccataccctgccggactgggtgcccgcaggcacgttgatggtccaggtctgccccgggttcagctgtgtgccgccgcccacaggggtcgccgctggccacactgtgtagggacagttgttctttatggtgaaggtggccgcgctagcgcaaccgactatggcggcgaggaggaaaaggaccgacgaggcggccggggatgccattggtagtggtcctcaggtcagagttattctgctacaagtgagctctattggtt

SEQ ID NO: 94 - DNA, 750 bp, Saccharum
cacagttgagaagaaagcacatacacatatacccatcatccacagctagctactagcgatggcatccaacaacaagtccgttgttttccctgcgcttctgttcctagccgtggcactcgtgttgacggcggcttcagtgcgagcacagtcaccagctccaccgccaccatcccaaaaccggtgtccttccggcttcactaacttcactgcgttcgtgcaaggccagggcacttaccttttacgtggcatcacgttgacactcctccttgccccggtcaccccaggcaccagcaccacaaactgcctttgctatcccactaccaacatcaccattggccccattgtcgtgcccaacctcaatggccccctcgcatgcgtgcaaggcccaatatgatgcacacaccggaattcagcatgctggcagtctggcacgaacacacagcacaaatgtgcccatatgcgcacttagctatttactcctacgtactatatatatacactatgtactacgtatatgaataacttactcccatgtgtgtgtgcatgcatacgttgtttgcatgcggagactaattcacatgttacgctatgcagtggcatgtaagaggagttggcccacaacctactttatatatatacaatacaataaagaaagacgatgtaatgtgtgtcgtgttcatgttgttgtaagtgtactcagaataccaaatatatactggaaccatattaattaaatgttttccttatatt

SEQ ID NO: 95 - DNA, 775 bp, Saccharum
ttttttttttttttttattttttttcgctttaaggggctgggttttatttattcgaaacgtctatatatccaaattttgatggtacacgaaatctgatcctgatacataggagcatacatatacatgatgcatgcgggatttccaggatggtcttattctcatcatcataatatagatactatatatacccactcatgcaatacttacatggtgacgttactgcatgaatgggttcatgccatgctttatatatatgtaacgcatgcatgcgtcgtcggccgaacatgcacactgctgcctcatggagtcgatcatggtcatgggcagaaggtgacctggtagtcgctgttgccggggcaatgatggagcttggagttgtcgtccggaaacaggtacgcctgagggcactgtgaccccgtgcacacgatgcggtcgccgccgctgcaagcgaaggccatggcgaggttgtagccgtcgatcaccgagatgtcgtagaagtcctggttgccgccgctggtgccgagcgtgaactcggccagcgtcaggggaggctgcccggagagggtgcaggagagcgcgccggcgcagtcgcctgtctggcagctcccgctgccgccgttgaaggagcatcccgtgcggccccagacccggcccgagctggtgccggcgggcacggtgattgtccacgtcccgcccgggttcagttgcgtgcccccgcccaccggcgtcgccgctggccacaccgtgaacccgcagttgttgcggacgcgtggg

SEQ ID NO: 96 - DNA, 422 bp, Saccharum
atcctatccatcacccatggcgaagttcctcaactataccagcagcgtccaaggactcttgatgctttccatggtacttctggcatcctgtgtaattgatgcacacataataagtggggaagccaaagaggttagcaacactgggagcgcgacgatgaccacgatgggggcaacaagaaagataattggagataataaagatttattgtgctatctgaaaggcctattgtactgctgcgataggatccaaaagtgctggcatgacataaaggagtgcttggagcactgccatggtggaaatgtgtaataaaaggacatgctttctccgagtcatagttcgagatcagaaaaatcaaaaatgttctaccaattcatgcatgtaccaaaggataaatataacctacttaacaaactcatgattt

SEQ ID NO: 97 - DNA, 1012 bp, Saccharum
  misc_feature 754: n = A,T,C or G
agattgtctagcaccagcaaagaaatctgcaccaaatcatatgggccacagaaaactatattttatatggaacctaaaatctagatattttctgtttgaaaacttagtatttcagatttcagatacttatgtttcgcaaaaaaaaaagatttcagatacttatagctgcataattaagcaataccacattaaagatgctgaatataatcaaagatagggccgggaaggggagggcatgtaccttgaacaaggagagcagcaacacctgtaagtaagcaactaaaacagatacttgaagaatgggttagagaacgcacctggggccagcaagaaaacacataacgcacacacggaccaaacctaacacatgtccatctccggagggggaggtgggagctgctctgcttccgctgccactgccggcgccaggtgctgctgcggcggatcgaacgtcacgtggtactccccatccacgcgcatgtagtagcggatgaacacgcacgcgatgagccacgtggaggcgtagcagagggactgcacgacgcggctgacgagtgtccagaagcgggcctgctcaccgtctgcggacattgggcgaggagggaggagcagcagcagcctcgccggaatcgatcgagggagccgccgggtcgagatcgcgaagcgcgtgcgcggagatctggtcggggatcgagatcaggatgcgggaatcgaaaactcttgggatggattgctctgggaggcggggggaggnacgcgcctccagagcaagccgggaagatgagtcgcagagtcggttttgtggcgtcgcgtatccctcgcacgcccaccggctctgcgtcccgcgccgctcgccgactcctccgctccctcggctcccgtccgcgctgctcccccgcgcccgcacctcgtcgtcgctcgccgactcctccgctcctcacccgccgcggccgtggcctgggagacgcggactaggactcggaactgacagaagccatctcgccccgttgcg

SEQ ID NO: 98 - DNA, 1682 bp, Saccharum
  misc_feature 1002, 1042: n = A,T,C or G
gaatccagtccaacccggccaggctcctccccccgttggcccgttccctcctcccctgtcccccacgcgttctccgcccctcgcgacggcaaaaccccagcgaattcccgacgcgccggcctcctccaatcccgccggcccggcgtcggtggcggcccagggattatccatggagaggtacgagctgctcaaggacatcggctccggcaacttcggggtggcgcgcctcatgcgcaacaaggacaccaaggagctcgtcgccatgaagtacatccccagggggctcaagattgacgagaatgtggcgagggagatcatcaaccaccgctcgctgcggcaccccaacatcatccgcttcaaggaggtcgtgctcacgcccacgcacctcgccatcgtcatggagtacgccgccggcggcgagctcttcgaccggatctgcaacgccgggaggttcagcgaggacgaggcgaggtatttcttccagcagctcatctgcggtgtcagctactgccacttcatggtgagaacaccaaccaacaaaaaggtacccagggaaaaaaaaatccatgctgatgaggtgtgcgactgcaaattttgtttcgattcattcacagcaaatttgtcaccgggacttgaagctggagaacacgctgttggatggcagcccggcgccgcgcctaaagatctgcgactttggctactctaagtcatcgctgctgcactcaaagcctaaatccacggttggaactccggcctacattgctccggaggtgctctctcgccgggaatacgacggcaagatggcggatgtttggtcttgtggagtgactctttacgtgatgctggttggtgcgtacccttttgaggaccccgatgatcccaagaatttcagaaaaacgatcgggagaatagtgtcaattaagtaccagataccagagtatgtccacatatcccaagactgcagacagctccttgctaggatcttcgtcgcaaatcctgcanaggtactgttgggcagtgaatcctgcaaagcctcaatcanttttactatggttaccatcttaatgccatatcgtctcatttcgtcagagaataacaattagggagattaggaatcacccctggttcctgaagaatttgcccagagagcttacagaagctgcgcaagcgaagtactacaagaaggacaacagtgcccccaccttctctgatcaaaccgtcgaagagatcatgaagatcgtagaggaggcccgcacgccgccccaatcatctactccggtggctggttttggttgggctgaggaagaagagcaggaagatggcaagaaacttgaggatgacgagcaggatggggaggatgaggaatacgattgcgaggacgagtatgacaaacaggtgaagcaagtacatgccagcggggattttcgacacctgataaagtgaagctcctggcaaggccaagttctcaactgatgagatactgtttggatttgttgtagtttgtggtgctgagatgctgcaccctcggtgcttacttgtagtttccttctgtctggatccaccttttttcgcatattgtgttatactctgtaaattatcaaactggcttcctcaatgcctgtgtaattgcaatgaaccgttgagtgattaagctagaaggcgaaatataatttctatggaat

SEQ ID NO: 99 - DNA, 1316 bp, Saccharum
gacagaagcaagaggctctcactgatgatgattgatgattgtcgctacataataataattaaatagatattagaggctagaagagcagagaagcagcaggagacggagtcccttgacagcagattacgacacatgatgatggttgatgattacagagggaacgaaaaccaaatttcacgcacgcacacgcaacgcggctgctgaaacaagagcgaccgacgatcgatgatggcaaattattctcctcactcacgcgcgcgcctgtctctccccccctacagtaagatcgaccgccattgctccagcagaagacgccctttgcaaattaaaaaaagcttggacgggacacgagaggctcctccgccgctcacgcgttgctcctgaaggagccgagggccttgatggcgccggcccggaggatgtactggtggtagaaggccgcgatggcagcgcccaccagagggcccacccagaagatccactggtcatcccagggcttgtccttgttgtagatgacggcggcgcccaggctcctggccgggttgatgccggtgccggtgacggggatggtggccaggtggaccatgaacacggcgaacccgatggggaggggcgccagaaccgggatgaaggagtcgcgcgccgtgcgcttggggtcggtggcggagaagacggtgtacacgaggatgaacgtgccgacgatctcggcggcgagggcgcccccgagggagaagccgtcagacaccgagttggcgccgccgccgagggtgttgtagggctgcttcatgatccccttcacgatgcccgcgccgcagatggcgcccaggcactgcgccacgatgtagagcagcgtgcgcaccagcgacagcttccggcccacgaagagcccgaacgtcacggccgggttgatgtgcccgccggagatgccggcggtgcagtagacgaggatgaagatcatgccgccgaacgcccacgcgatgccgaggacgcccacgccgccgcacgccgcgtcggcgcccgacgccgtcgcgtccgtctggtgcttgtacccgatcacggtggccaccgtgatgtacaggaacagcagcgtcgcgatgaactcggcgatcacggcgcggtacagcgaccaggaacccagctccgccgcgtcgatcagcggcgccggcggcgggtccgtgtagtccttggcagcgaactcgccgccgccagcgccgctctcgatcacgtcgtccttggccatggccgcctagcttggtttggcttagcttagcagctgcgagagagcgagtgggagagctagctccgcttgcaaggaa

SEQ ID NO: 100 - DNA, 1293 bp, Saccharum
gggagctcatggcaaggtctacaaggggaagtatggtgatcaaattgtagcgataaaggttcttaaccgtggtagtacccctgaagaaaaagcaacacttgaagcccgtttcattcgagaagtaaatatgatgtgtaaagtgaaacatgagaatcttgtcaagttcattggagcttgcaaggaaccattgatggtgattgttagtgagctactaccagggatgtcactgaaaagttacctgcacagcattcggcctagtcaactagatacacacactgcaatcagctatgctctggacatagctcatgcaatggactgtttacatgccaatggcataatacatagagacctgaaacctgataatttattgcttacagcaaatcgtaagaaactgaaacttactgattttggacttgcacgtgaagaaactgtgactgaaatgatgacggctgaaactgggacttaccgatggatggccccagagctatacagcacagtcacacttcgacgtggtgagaaaaagcattacacaaataaagtggatgtgtacagctttggcattgttttgtgggaattgttgaccaatagaatgccatttgaaggcatgtcgaatctacaagctgcatatgctgctgcttttcagcaaaagcgcccagctctccctgaggagaccccccaggagcttgtgttcatagtacagtcatgctgggtcgaggatcctgccatgcgacccagtttcagccagatcatccgaatgcttgaaactttcctgatgacaatacctccgcctccgctttcagaaccaaacgaagacgaggaatcggaggaaacaaggtcgtcactgagcagtaggagctcctctggctcctcgctcgtttctcgcgcgacaagcaagctctcagtcgtccgccacctcttcgcctcaaagaagacaggcaatgggaaggcgtgatgcgccatgccctgagacgttttccttcggtgctgtaaagatgctagcctaggtgatgcgtaatacaagagggaacttgttcagtgtagagtagctgttgtattgatgatacaaaggaaagttgatgcgcaacttctgcaagctatgtatagctcgcagctgctttactggaaactgtcctgctgtccaggcatccattccgttcaccgcatgtctgcattactgcatatttggcgccactgcaatgaaacgaatggcaaatgatatcaaataaacccttgattctgcagtacaaagtcaatgtaacacatcaagccatttcttttaacatgatgatgtac

SEQ ID NO: 101 - DNA, 1297 bp, Saccharum
cctcgtcgtgcacattggaccgtggacttgcagacttgcagtgccctgcgcctgccgtccgtcctctcctcactctattgtagctgtagttgtgctgacttgaccgcccacacaccttcctgcccttttccactcctccccaccacctcaaagttgaaccagcagctcccagcccatcccattcttcctccgccgcttgcgagctgagctgcccctgcccctgccctttcctttcctttcacaccggaggagagcagagcgcagaagcagcaagcaagcagagccggtcagcagaccagccctccccgtcccagtctccgatggcggctcgcgtcctcgcccaagtcctcctcgtcgccgccctcgccctcgccgcgcccgcgcgggcgtccaacgacgagggcgacgcgctctacgcgctgcggcagcggctgtccgaccccaacggcgtgctgcagagctgggatcccacgctcgtcaacccctgcacctggttccacgtcacctgcgaccaggccagccgcgtcgtccgcctggatttaggcaactccaacgtctccggctccatcggccctgagctcggccgcctcgtcaacctcaaatacctggagctatacaggaacaatcttaacggcgagatccccaaggaactgggcaacctcaagaacctgatcagcttggacttgtatgccaacgagctcactggaggaatccccaagtcactttccaagctcgactcactcagattcatgcgcttgaacaacaacaagcttacaggatcaattccaagggagtttgccaagctctccaacctgaaagtcatcgatttgtctaacaatgatctctgtggaactattcctgttgatggacctttctcaacctttcctctccgaagctttgagaacaacagcaggctcaacggtccagagctacaaggattggttccctatgactttggatgttagatgccgataccgatgcacaacaatcaacaatgtatcccgtccttagttgaaaggaggaaaaacaagatagtagtaccaatagaaacctagcttggggaatgccgtgattatatatatgtataatattcagacaagatttgacaagggtgtcatagcaggtcctgatattctgtgtgcattcagacaacagcataaaaaggaatgtattcagacaagtcctgcttgttgatattttgtatcgatggatggatagctgcttttatgcagctgtgttgataattcgcaaacccaaacaatccattcagaaataagggcacatattgttcatgaat

SEQ ID NO: 102 - DNA, 1627 bp, Saccharum
gtcaaactgttgatcagttgggctacgtccagtaagcaactctagcagtacgacaccaaagctgtaaacatcgctcttctcagtcgcctttagagaatacgcaagctcaggagccatgtagccatgtgtaccagcaaagcagctaagcgtcgaaccttccaccaattcagcaataccgaaatctgcaagcttagcttcatacttctcgtccagcagaatattggtcgactttatgtcctgatgaattatggccggggagcaatcatggtgaaggtacatgatgccctttgcaaccccaacagcaatcccgcacctcttgtcccagtcaagctccagctgcccagctttgaactcacggcaaatagcatcatacagattgccattcaccacatattcatagaccagaaagcttgatgctccagtcaaaaatgcattgagtttcaaaatgttacgatggcgtatcttcccaagggtatttatctcagccttcaagacctttgcatcatcacgcttccacaactccttcacagccacagttccccttcccttgctcaattctagcctgtaaactttgccggtgcccccacagccaatcaaattctctgcatccaagttgcatatctcctcagggtcaagttctaggggttggaaggtctcaagaacccacttcgaatcagtgtcactgccactctcaatatccccttttctgttgaactcttctagcttataattttcatagctcagacatgccaacccaaacaggagaacaattaaagatatcacagttaccagaacaagaagaagccgtctccttgacaagttgtcacggttatcggaccactgacaaggttttagattagtgatactttgtttccagccatctgaagtgtctgcaacacaaaggccagcatttcagagaatgcataatctccagctatcatcaagagttggggagggactgggccagacaactcattgtgggagaaatcaatatcgctcagcttcagtgactgcaaaccttcaggaatgtcaccagagatcatgttatgggatatattgagtgaatccagagtgacaagggagaccagtgtgtccggaatgtctccagtcaaagaattctctgcaagattcaggtcaaccatgctactgcacataccaatatctggcggtattggcccttccagtgcattatgttccaaatgcaggtaagtcagctgcttgagacttccaatctgtttaggtatttggccagatagtctgttgttggaagcaaccaacttctgaagcagggcgagcctccccagctctactggaagctccccaatgaagtggttgttctgaacatacagctggttcagagtaactgaaaagcctatatcagaagatatgcccccaataaatccattatcagcaacatcaattatcacagcattaggcaacccccacaagccagcaggaatactcccactgaattgattttgacttattctgaacctctgaagtgtcttgcaggaagagtaagagccggggaattcacctgaaaagttgttggtcaaagccagtaagaactgaagcttcttgttttggcacaagaatcttggaaattcgccagaaaagtaattctctg

SEQ ID NO: 103 - DNA, 958 bp, Saccharum
gatcaatgaaactggtgaaaccaggtacagtatttgactcaaagataaaaaggtttacatgcagatacaagacaataatatcattgttctctgaacgcacatgacctccattggtaaaattgaaatcgaaccatgccacagaaatatatagtgctctaagcaaatgcaaagattaattattcatctgtggtggtgctcagtgactaatactcttcttcatcctccagtgacccagcctgtgatgtcttctcgtgatcgttctcaagctggctgaagtttcccttctctttgatcagctgaatgtggtggtgcttgcagtagagcttcccctcgtgcgcaatgtagttagaagggctgatggtacatcctccatggcagcacttgaagcagctcttgtgatacatagtgttgttgacagtaaccctctcaattggatagactgtcttgctgcatccaacacatttctctctggtgccagcaaaggcgcttgagactttaacagcattctcattcccagcgtttctttctggcttgacaacctttggagttccttcaaagcttttgtccaaactcccggtcctcttgaacagctggtcgaagtgaggcctgcagtagagcactccctcgaaggagttgtagttggcaagcttgagggtgcccttgcagtggtggcagcggaagcaggccttgtggtagatgcggttgtcggcggtgagcttgtcgacgaggtacaccgtcttgtcgcaggcggtgcacttggtggtcgtcccctggaaggaggtcgccatggccggccctcttccccctctgcaacgacacactctgcgtacagagacgaggctgctagaggtatgctatggtgtagccgcactccacaaactccccagcgccttgcgttgctgctgatcgatggttatatgggaactgggaactgtggtgtggcgtggtgtggttggtg

SEQ ID NO: 104 - DNA, 2403 bp, Saccharum
gccttgaatcattaaggtaacaatatgttaattttagtaaccgtctcagccgcttggctctttacaagttcgactatcatacagcattggggattataccaagtgccagggctcaaggtagaagccgattggagaatatttaaaccaccagaaaccagagtggggttaagcatcataaccctctatggaaaatgcatctagcatatacatgtacaattctagaggcccaacgaaaaaaaactgtgggtcaagtctcatgcggacgaccaactagcagtataagtctttggacatatcatggtcagctctactctgatggatccagctcaatgttatgggttgctcttgagcttctttcgaggtttcaagtcaaccacaattacagtgatattgtcctcagtacccttcttcagtgcgagcctcataagataatcagcagcggcttgtgcagcaggatcagtggattcatcactcccattacacaatgatgatgtgacactattgttcttgtgccacatttggatttgccgacgcgcaactttgcatgcctcttcatttgtcactacatcccacagtccatcacttgcaagaatgaggcagtcgtcatctttcgccctaggaaagactgtaacttctggttttggaatgacgaatggtttcaaataccggtcccctgcaacaagtgtttccaagtttaagttagaaaaaggtgacgaaaattggacaaatgctatccaacccacagagaagtcagctgaactgttggttcaactaaattttcttttgaaattggaggaacaatattgtccaagagtttagcacaatggtgcatctgattttaagatggcaatgaatgttaacatttccaaacaagatccattgatggttagccatggtccaagctgcaagtgccacttgctggaatcatgacatgaggtacctttgtcgtgtcgattaaagatggcttttctactgcggagaacttcatttcctaatcacatctgcattctgtgttctataccatagaaatatacttaaagctcattttaccacttcactgataggattagagccaatatccagacagtcaaatcccagaacatgatttcagtagtgttttaagtctatcatgcttgctatctcggatagaaacaagcagtttaaaccaaatcactgataaaggactttttttaatatatagaacagctacaacatggtaattgtaaacgagggcagataaaaacagctatcttcctaaatggaagcatggcatctagcgaaatcaccatgctacagagtatagtacagagtctttcaacaaaatgacttctagggaaaaattgcctaggtcaatatgaaaccttattccattagattgaagataattctctagatcatatagagcaattataaaccaatgtattcttcagtcggttcgtttcaaggaggatctaagattagccttttgcttttgattagatgcatatagttaattctggttgtaagtatgttctgtactatttaaattttataaaatgagtgctgtggggaactcccccacagttttgccttaaaaaaaattaataataataccacaaaaaaactgattcctacagcaactggctgcttagatttgatctcagaacttccacaaagtcctattacaccaaactaagatactttacaacatgcagcaacagcataagcattttcatgttgctacaactgtaatttccatcccacttaaaaaaagtaattctaccaagatctagctgaggaaccaatatacataccaatcgatctcgacatagcaagtataccggagacccggtagccgttccattggatgaccttgcctcccagggcctcaatcctcgcccgctcatccttcctgtcaggcttgtgatcaatcgacagctctacgggctcttttccacggcagagtacggcacgcgaatccccgcagttggcgaccaccgcatgggacgagcacacgacggcgacaaccgcagtcgagcccacgttctcggcagccaccggccgtgactcctggactccatcgacgagcctgctcgcctgccccgacacctcgtcttctagcctctggaaacacctggtgaacagctcgtcccagtgctccttcatgtccacctctgctgtctcccccaaatccttgccgagtagcctcaggtcctgccgcaacagcacctggagcctctcccggcagtagttcgccacctcggcgccgccatggccatcgaagacgccgaacaggtgcgccggcaggcggagcgcgtcggcgtcgaggcccaggccgtcgaggtcgcggcggctggcgagcaggcgcaccggcacgtcggcgaagcgcggggccgcggcgcaggcgtcctccatctcggcgct

SEQ ID NO: 105 - DNA, 514 bp, Saccharum
aatcaatcccaatcccatccatcggcagagaaaagcttggcactgcacaggagaggaagaggatcggctgccggagtgcgatcaccgacaccgagcagcttgcagatcgagaagaaggcaggcagcagccatggcggaggggacggccaactgcgtggacatcctgatcgccatcatcctgcccccgctgggggtgttcctcaagttcgggtgcgggcaccagttctggatctgcctcctcctcaccttcctcggctacctccccggcatcatctacgccgtctacgccatcaccaagtagcttagttattggctgagctgctgctgctgctgctgctactactactgttcctttgcttgctcagctcgccgatatgtatgcatggatgccgattccaatacctgctagtaccacctagtgctctgctcttctatgattgtgtctatgtgttcatatgccgtgccgacttgtgtgtgatcgtcgatgaatcgaacaaacagtcattaagctact

SEQ ID NO: 106 - DNA, 711 bp, Saccharum
ccgtgctttcatcaaagagtagctaagcatgctgaatgcatcacgcacgcatcctgattcaactcgtctctatcctgctgccatctttttcaccgtcagctgtacagtaatccctgtaacaacctgggtgaaattttttccacgcaggacagtgaaaccacaggaccgagcggagaagactcctgacattcattccattccgttccaaagggggtgagaaggcagggaatgagtacaaccaaggtgaagagacgtgtgggcaagtatgagctcggccgcaccataggcgagggcacattcgcaaaggtcaggttcgcgagggacacggtgaccagcgaggccgtagccatcaagatcctagataaggagaaggtactcaagcacaagatggttgagcagattaagcgggaaatctcgacgatgaagttgatcaagcaccctaatgttgtccgcatatacgaggtgatgggaagtaaaacaaagatctacattgtgttagaatttgctactggtggcgagctctttgacgcaattgttaaccatggtcgaatgagggaagatgaggcaaggaggtacttccaacaattaatcaatgcagttgattattgtcatagcaggggtgtgtaccaccgggatctaaaacctgaaaattactgcttgattcatatgggaacctgaggtctctgactttgggctgagcgctctatctca

SEQ ID NO: 107 - DNA, 1781 bp, Saccharum
ctatttagtaacagcaaaataggtaaacaggcgaacactgcaacaagggtagcaacaaaactcataaccatggctcataccctatgttcgatataaaaataacagaaatgagtcttaatagcaccctggttttttaacgaaaataaaagttctaaatcgaccggacaaacattgccaacacagtttagttgctcacgcaataacagcaataacgtgaacaagacgagatattttaagctcccactaggtatccccaagcaaacacagaaccagccagacacctcatttcttcttggcggcagccttggtcaccttggctccagttgggtccttcttctccacactcttgatgactccgacagccaccgtttgcctcatgtcccgcacagcaaagcgaccaagaggaggatattcagagaaggtctccaccaccatgggcttagtgggaaccatcttcaccataccagcatcaccgttcttgaggaatttgggctccttctcaagctccttgccagaccgcctatcaatcttggtaacgagctcagcaaacttgacagcaatgtgtgaggtgtggcagtccagcactggggcgtagccgttgccgatctgcccagggtggttcatgatgatgacctgggaggtgaagctagcagcctccttggcagggtcatccttggagttggaggccacatacccacgcttcagatccttcacagcaacattcttaacgttgaagccaacgttgtcaccaggaagagcctcttggagagcctcatggtgcatctcaacagacttaacctcagtagtaaggccactgggaccgaaggtaaccaccataccgggcttgatgacaccagtctcaacacgcccaacaggaacagttccaataccaccaatcttgtacacatcctgaagggggagacgcaggggcttgtctgaaggcctcttcggctcattgatcaagtccagagcctcaagcagggtggggcccttgtaccagtcaaggttagtggacctctcaatcatgttgtcaccttcgaatccagagatgggaacaaagtggatcttgtcagggttgtacccaaccttcttcaggtaggaagagacttccttcacaatctcatcataacgggccttggagtacttgggtgtggtggcgtccatcttgttgcagcagcaaatcatctgcttcactccaagtgtgaaagcaaggagagcatgctcacgggtctgaccatccttggagataccagcctcaaaaccaccagtggtggagtcaatgataagaacagcacagtcagcctgggaagtaccagtgatcatattcttgatgaagtcacggtgtccaggggcatcaatgacagtacagtagtacttggtggtctcaaacttccacagggcgatatcaattgtgatacctctctcacgctcagccttgagcttgtcaagcacccacgcatacttgaatgaacgcttgttcatctccgcagcctctttctcgaacctctcgatcacacgcttgtcaataccaccaagcttgtagatcaggtggccagtggtggtcgacttgccagagtcgacatggccaatgaccacaatgttgatgtgagtcttctccttacccatggctgaagggaaacgctacactgctcgtcgggcgtcagcagagtggcttggttacggctcgccgctgatctgaggatacggtgacggcgcgtcggctactcccggtctgcggcggccgactgcgtcttggggtttgagaacagaatggagctagg

SEQ ID NO: 108 - DNA, 869 bp, Saccharum
ggtttcctcccagccgtcatcgcttcgcgtccccctcagaggttcagaccgccgccaggagaggtaaggagggagttttgacaagctcaaatggctcctaaagccactcctgccaagaaggctgatgccaaggcccaggccttgaaggttgccaaggctgtgaagtctggggcaggcaagaagaagaccaagaagatccgcacgtccgtgacatttcaccgccccaagaccctgaagaaggccagggacccgaagtacccaagaatcagcaccactggaagaaacaagcttgatcagtaccaaatcctcaagtaccccctcaccacagaatcggcaatgaagaagattgaagataacaacactctggtcttcatcgtcgacctcaaggcagacaagaagaagatcaagtccgctgtcaagaagatgtatgacattcaggcaaagaaggtcaacaccctgatcaggcctgatgggaagaagaaggcttatgtgaagctgacgcccgactacgatgctcttgatgtggccaacaaaattggcatcatctaagttacaggcaactggattcggcatctgagccctactagttctatgtgagacgagagtttttgtcgctattcctttctatggcactcagtggctccattaccgtgtcttgatgcacgcttatgatttctatatcatccaagtgaccggttgtgctaattttagctttgagcatactgtcagattttcctatgttactagtaattttgttatattgggttggtttttcaactaagccttgttctgaacctcagactacctatgcctgtattgagtttctggttgccgattaaccattttgtactggcattattccacttccg

SEQ ID NO: 109 - DNA, 1473 bp, Saccharum
cggacgcgtgggcggacgcgtgggtttggttcctcgtgttcattttgcccttcccattcctctccactgcggtgccaccacctcgggccgggccccgtggggaaccagaaccacctcctcaccggcggcggcggaggcgaacggcgaccgcgacctcccccgaggccgcacctactaggattggattttagctccccggttctggattggttggttgcccgcggcaatgggaggagggccgtggtggtgtccatagggaatcctcggtcgcgtccttgttgcgatggcttcgacctctgttcctaagttagtcgcggacaagaaatgcgataaagccattgcggataccaccgcaccattgacttctcagggacactctgaagaaccgactgggaaagtcagcaaactggtgccttctttgccgattgtaattgcaactggtgatggggctgcatccagtggggtgaaagaaaacaacaatgacatgagcagttctgctgatggttctgtgaagctggatgacagtgaagatgctgagaagagctcgctgcgggggagtgttaaggatagctcggtgtccgctaaatgcagtgacagggccagcagcctgtcgaaagccagcgttagtgccaaggttagtggtcaacctgctgacatgatcgagagtggcaagagtagcctctatcgggccagtggtggcagtgatgtgagcgatgagagcacctgcagtagcatttgcagcagcgtcagcaagcctcacaagtcaaatgactcaaagtgggaagcgattcaggcggtccgaacgaaagaaggtcccgtaggtctaggtcaattcaggctactcaagaggcttggctgtggtgatattggcagtgtatacttatcagaacttagtggcactaaatgctactttgccatgaagatcatggacaaggcatcactagcaagccgcaaaaagctgcttagagcgcagactgaaaaggagatattgcagtgcctggatcatccttttcttccaacattgtacactcactttgagacagataagttctcatgcttggtgatggagttctgccctggaggtgacctccataccctaaggcaaaagcagcctggcaagtatttccctgaacaagctgccaagttttatgtagcagaggtgcttcttgctctggaatacctgcacatgcttggtatcatataccgtgacttaaagccagagaatgttcttgtgagagaagatggccatatcatgctgtcggatttcgatttatccctccgatgtgctgtgagccctactcttctcagatcttctgaccccagtggggatagccaaaagggcaacccagcttactgtgtgcagcctgtgtgcattgagcctgcctgtatccagccttcttgtgtcacgacaaccacatgcttctctcctcgctttttctcttccaaatccaagaaggagaaaaaaagacaaaa

SEQ ID NO: 110 - DNA, 2678 bp, Saccharum
cttcccacaaagccaaagctcttcttcgatctacagcactgtcacgcaattagctagctgtactaataatccgctagtagcagtgtatttagccactactactcttgtgtagcttttaattttccccagctagctagtttctacttctgtcgatcgtccgcgttgttcctctcatctgtgtacgcaacgcacgcacgtgtcgcaatggagtgcgagaccggctttgtccgctccctgaacggcgacggcctgtgcatgtcggcgccgcgcgcctccgacccgctgaactggggcaaggccgcggaggacctgtccgggagccacctggaggaggtgaagcggatggtggcggagttccgcgagccggtggtgaagatccagggcgcgagcctgagcatcgcgcaggtggccgccgtggccgccgcgggcgccggcggcgaggcccgcgtggagctggacgagtccgcgcgcgagcgcgtcaaggccagcagcgactgggtcatgagcagcatgatgaacggcaccgacagctacggcgtcaccaccggcttcggcgccaccttccaccgccgcaccaaggaaggcggcgcgctccagagggagctcatcagattcctcaatgccggcgccttcggcaccggcgccgacggccacgtgctgccggctgaggccacccgcgcggcgatgctcgtgcgcatcaacaccctcctccagggctactccggcatccgcttcgagatcctcgaggccatcgtcaagctgctcaacgccaacgtcacgccgtgcctgcctctgcggggcaccatcaccgcgtcgggcgaccttgtgccgctcttctacattgcgggactcatcacgggccgccagaactccgtcgcggtggcccccgacggcaggaaggtggacgccgcggaggcgttcaagatcgccggcatcgagcacggcttcttcgagctgcagcccaaggaaggcctcgccatggtcaacggcacggccgtggggtctggcctcgcgtccaccgtgctctttgaggccaacgtgctcgccatcatggccgaggtcatctccgcggtgttctgcgaggtcatgaccggcaagcccgagttcaccgaccacctgacgcacaagctgaagcaccaccctggacagatcgaggctgccgccatcatggagcacatcttggaaggcagctcgtacatgaagctggccaagaagctcggcgagctcgacccgctgatgaagccgaagcaggacagatacgcgctccgcacctcgccgcagtggctcggcccacagatcgaagtcatccgcttcgccaccaagtccattgagcgcgagatcaactccgtcaacgacaacccgctcatcgacgtgtcccgtggcaaggcgctccacggcggcaacttccagggcactcccattggtgtgtccatggacaacacccgtctcgccctcgccgccatcggcaagctcatgttcgcgcagttctccgagctggtgaacgactactacaacaatggccttccctccaacctgtccggtggacgcaacccgagcttggactacggtttcaagggcgccgagatcgccatggcctcctactgctctgagctccagttcctgggcaacccggtgaccaaccacgtccagagcgcggagcagcacaaccaggacgtgaactccctgggcctcatctcctccaggaagaccgccgaggccgtcgacatcctgaagctcatgacgtccacgttcctgatcgccctgtgccaggccatcgacctgcgccacatcgaggagaacgtgaaggccgccgtgaagaactgcgtgacgcaggtggccaagaagtccctgagcctgaacgccaggggcgggctccacaacgcgcgcttctgcgagaaggacctgcagacggcgatcgaccgcgaggcggtgttcgcgtacgcggacgacccgtgcagccccaactacccgctgatgcagaagctccgcgcggtgctgatcgagcacgcgctggccaacggcgacgccgagcgcgtcgtggagacgtccatcttcgccaaggtggccgagttcgagcagcaggtccgcgcggcgctgcccaaggaggtggaggccgcgcgcgccgccgtggagagcggcaaccctctggtccccaacaggatcaaggagtgccggtcctacccgctgtaccggttcgtgcgcgaggaggtcggcaccgagtacctgaccggcgagaagacgaggtcgcccggcgaggagctgaacaaggtgctcgtggccatcaaccagcgcaagcacatcgacccgctgctcgagtgcctcaaggagtggaacggcgagcccctgccgctctgctgagctgctgcacctgcactgcgctgcagcagagaagacaaggtatacagatcgaagaaaaaccaaagtatagcggctcgatcaagacagagcgtttcaagatcattgtgaagtttttacaatcagactagcagaagatactctctatatttaccgtttccttgtactagtagctaaagttcatgtgaatgttgttgtgttcccgcagctgcggcgccatggcctgcaatgtgcatgttcttggctgctgcagctactgaaacttttgatggttttaacttgtaagttggggggataaagtaaattattttgttctatactcc

SEQ ID NO: 111 - DNA, 1401 bp, Saccharum
  misc_feature 1006: n = A,T,C or G
ccgttttcacttgccaccattccccaccaccgcatagatcgccgccggtgcggcgatggctccggccgtggccgcggcgtcggcgtcggcggcgatgagccaggcactgcgggaccgccagatcctcgacgccgtgggcaccggcgccgcggcgctctcgttggtgggctcctccttcatcgtcctctgctacctcctcttccgcgagctccgcaagttctccttcaagctcgtcttctacctagccgtctcggatatgttttgcagcttattcactatactgggggggccatcgaatgcattttactgctttgcacatgactacagtgcccatttcttctgtgtggcttcttttctatggacaaccaccatagcattcactctgcatcgcacagttgtaaaacacaaaactgatgttgaagaatttggatctattttccacttatatgtgtggggaacttcactagctaccactgtactacgttcgataggaagtgactacggaagaccaggtacctggtgctggatccagcagggaagcatggcaaaggtcctacacttaataactttttatcttccactttggggtgccattttgtacaatgggtttacatactatgaagtaaaccgcatgctgaacaatgcaacacggatggctgctggcataagtgatcgatcaaaccagtctgatattagggcagacaggaaggcatttaaccgatggggttattatcctctaattctaatcggttcatgggcatttgcaactatcaatcgtctttatgactttgccaatccagggcataagatattttggctctccttttcttgatgtgggttcgctggactaatgggcctattcaatttcattgcttatgggctaaactcttctgtgcgccgagctatttcagaaagaatcgacatgttcctacctgagagaatcaaaaggagcctccctactttgtcaagattgaggagtcaacaggaaaatgaactgacttctctnatcgtcgagggtaactgatatgtagtgcaatctatgaattttccatgcatacaattttttttaatcttttcgttcttcgatctccaacaagggaatacaacatcactgtaggagcagttggttagcattgttgatcgtccggtacacgtcgagttggtttcgctgtgtccattgttgattgtcttaacacgagacctgggtttggtgttcatagttccggccaaagtatataggaggatagaataggaacagtcggtagatacactgatgttcatctgtagctaggtaagcagaatttgtttgttcagatgtacgagtataatcacttatgtacaatgcacatctagcgctacacgatttgcaacttttcagtttttctgcttttgccccttatt

SEQ ID NO: 112 - DNA, 665 bp, Saccharum
agcccaagcctgatgggatgggttggagccagatcagcaagagcaatatcctgagcagctttgtaagcattcatggtgctctccgcagcatccttcctctctgcacctgacttgaactcagcaaggtacctgtggtagtcgcccttcatcttgaggtagaagaccttggactcggcagcgccggcggacgggacgaggtgggagtcgagcagcgcaaggatgccgtcgcagatgcgggcgagctcggcctcgatcttggagcggtaggcgcggatggaggcagcgtgcgcctcgttcccgcggccctcctccttctgctcgatggaggagatgatccgccacgaggccctgcgggcgccgatgacgttcttgtaggcgacggacagcaggttgcgctcctccacggagagctcctccccgccgccggcgccgcccgcggagcgcgccacgcgctccatgaactcgaccatctcctcgtaccgctccgcctgctccgccaacttggccatgtacacgctctcctcccgcgtcggctccgacggcgacatggctgcgagctcggggtgggacgggtcggcagatcgggatcgccggcggcggcggcggcacgggcggggtcacacggttgcggtggcgcagaggatcctgtggagcggaaggaaacg

SEQ ID NO: 113 - DNA, 2279 bp, Saccharum
atacaggaaatatggagactattttttatttctctgaatattggtgattacaccatagagctcccacgtgtatataaagtcctgctaaggtgtaggaatatggtaagctatgatgattaggattcctcctcatttgctcgagaatagaggagtccgtatgtatttattacaacaaagagtatagtacgtactccacgtagagtagatatgatgcatacggacggacatggatagtcgatatccagcgaaaatccgttttttttttactccgctgcgtaggcagacggcagcagcctgggtgctgggcggaccatcaacggcacggcgcgctgcagggtgagcccgtacgcctcctccatgtccagcttgtccgcggtcatgccgtcggcgaggtcccagtccagggcgtgcacgagcgtggccgtcatgagcgtgaccatgcgcaggccccagctgaggcccgcgcagatcctccggccggcgccgaacgggatgagctcgaagtcgctgcctttgacgtcgacgcccgcgtgcgagccgcccggcaggaagcggtcggggcggaactggagcggctcgggccacgcctccgggtcgcgggcgatcgcccacacgttcaccagcagcgtggttcccgcggggatgcggaacccgtccacctcgcactcctcggcggccacgcggggcagcgacagcggcgtggacgggtgcagccgaaacgtctccttgatcaccgccgtcaggtacgtgagccgcgggaggtccgactcggagaccaggcggtcgcggccgacgacggcgtccagctcctgctgggccttcttgagcacgtccgggtgccggatcagctcggccagcgcccactccaccgtgctggacgtggtgtccgtccccgccgtgaagagattgaggaggagtgctttgatgtcagtctcgttgatcctgctgtcctcgccgtccgcgagcggctgctgctcccgcatgctggccagcagcacgctgagcaggtccttgccttccccggcggccttccgctccctgatgatcccgttcatcatgtcgtcgtacctgcggtgcagccgcttcatcttgccgaccacgccctgcgggtcgagccacgccagcgccggcacgaagtcgccgacgttgaagaccccggcgagctgcatcagctccaccaccatgtccttgaactccctggcttcctcccctccgtcgaccgcgaacacgcgccgccccaccgtcgcccgggccagcgtgttggtcgcgcagacgttggccacctggcccagcaccacgggggcgtgctggtgccgggcgagctccctcaccatgagcgccacctcgccctccctgacgccgcgcaggtcgtccagggccttggcggagaagaggtggagcgcgcacagcttccgcagcgcgcgccaccgggagccgtagggcgcgaacaccaggtcctggtagttgtacgccacgtgctcggctccggagtttggagggcggttgctgaagttggcgtcgtgggcgcgcaggaattgcgccgccacccgcgccgacgcggccaccaccacctcggcgctgccgaaccggagccggaacagcgggccgtactctttcgcaagcgcgcacatggtgtggtgcggatgagaacccacctgcggcaggttgcccagcaccggccagccccggggtccgggcggcagcggtcgcttccccttcccgccgtccccgccgcggcggagcaggaggaaccacaccacgacggagacggccagggagcccagcagcagcggcagcggcacgtccatggttttacttgctcggttcacgggaggcgcgcttgtttattttcggggttttacataacatcctcttagcctcatagcctggctcaagttatccattattgtcactggctagtactacagctcctgttcccgccttgcattggatgtccgccagctttggccactagctaggtgcctcgttggaactcgagttccatgcatgtacaatgcccaccgttacatgacatcggttttttacactaaccctgcagatcactcccatccctgggcgccactcgcgcaccagctgaagttgaggctgaaggcctggtcctcggagaagaagccccccgcgccgtcgttgccgatgacgtccgagctggcgagccactcctccgtgaagccatagccggcgcaggtcttgtacgagtcgaaagggtatgtcgtcggcccgggcagccacttggtctcgaacaggggggaagacgagca

SEQ ID NO: 114 - DNA, 1251 bp, Saccharum
agtacatcaggtatgtggttctccattgggtatatatcatgtgcctcaattacattgactctcacataccacattcttggtgcagggtagaccttcccacgaatataattgtgaagatgggattcaactggtgttgatcctgcatgaatggcgcttgggaagcattcatctgcttgagtaccataccagactgcaagcatcaactcccctctgtccctcatgccatccttgcccataagacgataccactctggtgccaatggactgtctggagggacccttagagggacctcattcaggtcaatactcaccccccccacttttttttttttttttttttttttttttttttttttctattcgaaatgagcaaacattccttattcagtcaaacttgcataggattccaaaacagaatacctcgtatataaactatgtatgccctttttcttcccacatagaaaaccatgagggtatacataatcacacaaacaaagcatcgtacatatagtaccacttataacatctctagtccataccgtacaccgcacactgcgcatagagcagctttattttgttttgtatgaaaaaaagaggaactccaggaaagaaaacgaaaattaaacccaaacttcaggaaggggaatcgcatcccaatgacccaatccaccgatttagttgtaggcgtcggggttggcgacgaggtaggcctcggcacccttgaaaatggcggtgagcgactccttggccttggtgatctcgtccttcacctccacgcccggcagcggcttgaacgtcgtctccaccttcgccacgctgccgccgccggccgcgggctccaccttgatgtgcgacgtcgccgtctcgatgccaacgccgatgccgccgccctcgatgagcgtttgcttgcactcgcacttgtccaggtccaggaaatcgagcctctccttcgtgaaggtgaacggcatgactgaggtgaagttgaactgcctgatgctgccaacgccgccgtcgccctccacagggtgggcgctcgcgacaacgtgggaggcgagcttgggcgccagggtgtgccagtccaacacggcggcgcggaacaggcgcggtgcggccaccggcgacgcgatctcgagggtccagctgttggcggaggccattacttcagtgatcgctggccgatcgactaaacttggttcgagctgaatgcttaggtgctcagctctgaatgcttaggcttgccggacgcgtggg

SEQ ID NO: 115 - DNA, 1412 bp, Saccharum
tcaatccactgcagcaggcagggcaaatcgagcacatggttcgatgcatccgaatgaaacgccctaaacaaagcattacctatttattttccacattggtacacagctccggtgaggaactctggctgccaagaggccagacgctacgatgtttccgctccgaaggattcaggcaccgtttggtttgaacgttaaattttaacaaacacggtaacactttcatcttatttgacaaaaaaatttcctgtcttgaactaattaggcttaataaattcgtctcgtaacttcaaagctcaataaaacgctagagcgaccagacatgcttgtcaaatccaggggaacaataccagtccacacggacctagtgccaactagctgcaacacaaagcaatgggaactcattcgaccactaccagcctactaatgaggcaaaagtgaggggaagaggaaatctgctacaataatggcacggcacagcttcgacagcatagagcatctaaaaccaggctggaacaacatgccctctccgaagattactgtccctcgccagcatcgccttttgaggcttctttgccctcatcagcaccatcctccgtgaggtcagaggtccaaagggtcaagttgtccctcaggagctgcatgatcagagtgctatctttgtatgactcctccccaagggtgtctaactcagagatagcttcatcaaacgcctgctttgcaaggttgcaagctttgtctggggagttcagaatctcataatagaacactgagaagttaagagcaagcccaagccttatcggatgtgtaggtgccagctcagccagagcaatgtcctgagcagccttgtaggctaccattgtgctctcagcagattccttcctctcagcaccagtcttaaattccgcaagatacctgtgatagtcacctttcatcttcaggtagtagacctttgattcggcagcagtagaggaaggcactaggtgggagtcaagcagtttcaggatgccatcacacatgttgttcagttcagcctcaatcttcccacggtattccttgataaggttcacatgctcttcgttctcacgggactcctcattctgttcaatggaagagacaatgcgccatgaagcacggcgagccccaatcacattcttgtatgcgacagacaggaggttacgctcctccacagtgagctcttcgacatttacagtattagccaccttctccatatactcaaccatctcctcatacctttcggcctgctcagccagcttggccatgtaaacattctcctccctcgacatattgttaaaaagaacaaacttactcctggcgcggggctggcttctgtgcgcggcggaacggtgtggtcgcccacgcgtccgcccacgcgtccgcggacgcgtgggtcg

SEQ ID NO: 116 - DNA, 1569 bp, Saccharum
  misc_feature 408: n = A,T,C or G
taggctccatgccggtgctcaccctgctggacctttcgtcgaacctgctttccggcgccataccgccggcgctgggatcgctgaggttgaaccagcttaacctgtcgtccaaccagctcatcggcgaggtcccggatgtgctggcccgcacctacgaccaaagcttcatgggcaacccaggcctgtgcaccgccgcgccgttgccgggcatgcgatcgtgcgcggcccagccaggcgaccatgtctcgccgcgcctccgcgcgggcctccttggcgcgggcgccgcgctcgtcgtcctcatcgcggtgctcgccgtgttcgttgtccgcgacatcaggaggcggaagcggcggctcgcgcggaccgaggagccctggaagctcaccgctttccagcccctggacttcngcgaggcctccgtgctgcgcgggctcgccgacgagaacctcatcggcaagggcggctcggggcgcgtgtaccgcgtcacgtacaccagccggagcagcggcgaagcggggggcacagtggccgtgaagcgcatctgggccggcgggagtctggacaagaagctggagcgcgagttcgcgtcggaggtggacatcctcggccacatccggcacagcaacatcgtgaagctcctgtgctgcctctcccgcgcggagaccaagctcctcgtctacgagttcatgggcaacgctggacggacacaaaaaggcagccgggaccgccgggagcgccatggcgagttccccggcggtccggcgggagccgatggactggccgacgagggtcaaggtggccgccggcgccgcgcgcgggctgtactacatgcaccacgactgcgcgccgcccatcgtgcaccgcgacgtcaagtccaacaacatcctcctggacgccgactaccacgtcaaggtcgccgacttcggcctctcccgcctcttccccctcgacgtcacgcacgtctccactgctccccagggcacaccagggtatgtagatccagagtaccaccagtgctaccagctgacggacaagagcgacgtctacagcttcggggtggtgctggtggagctcatctcgtcgaagcccgctgtcgacatcacccgacaccgcaacgagatcaacctggctggcatggccgtcagcaagatccagaagtgccagctggaggagctcgtcgacctcggcctgggctacgagaccgacccggccaccaagaagatgatgaccatggtcgcggagctggccttccgttgcctgcagcagaacggcgagatgcgcccgccgatcaaggaggtgctcgaggtgctcaggggcatccagggtgaatgcctgatggagaaggatggagacaagaagaacaaggacggccccgtctctcccaccacggttcatgctccgtgggacagcagggccaccacgcccaacaccagcaagtagattagttagtactgaggaccaagaccgcccgagatttatttgtgtttcatgtttgtatttaggcttccgcatagagaactgcttgctgttgtactactgtgaggcatgccagattgcctgtcttttgtt

SEQ ID NO: 117 - DNA, 1247 bp, Saccharum
atctaatcataaagaggtgcagagaagataattttgtaagtgttgtgcacagtacacaagtggtggtagaacgccaagaaagggttcatcgactctcagtcaacttgagtgaaggtgcagaggatgacaccaaattgcaggtggccactaattgctgccaatcacaagttcgttctcttgtcttgtttggaggatcgaaatggatgcctccattgttggagcttaaatctctccgggtgctttactttgaatttcccaagcaccggaagagaatggacctcacaggtgtcgaccaattgtctcagctaagatacttaaagattggagaaagttattccggaggactttccgttgtgctacctagtgaaattcgaaggatgcgacatttagagaggctggagttacctctcttcatagacgttgtcaacactccatctgatattgttgacttgccatgcttgtcccatctgatcttgccattgggtacaagtttgatagacgggattgggaagatgaaatctctgcgtactctgaggtattttttattagcagagagctcgccagagaatattaagggcctcggcgaactcaacaagctggaagagttgcatctcgaatgcttcagagacgacttaatgaagcataggccgagacgcacggatgatgatacacccacagctatctggatggatgctctgttttttgccctggagaaactaagtaacctcaaagacttttccctgatgtctctttatatagctgtcagtgctgatgcactaagcttgctttctcctcctttccacaacctcgagacgctttggctttccagattgatcttctctcgagttcctaggtggatcggaggtctccaaaagctctgcgagttgagtcttggagcaaagcagatgccccaggaagatattgacaccattgggacactgccatgcctcctccgcctctggctgtggatcccaggcgtccctacaggcagtatcgtgataggtggggccacagggttcaatgctcttgaggaatttatgtttgactgtgatgtcatgtcgtacctggcatttgaggacggagcaatgcctagcctccggaagctcgagttacgactagatccacacgtatgggacaaggccacacctctcggactccaatatctgtcgagcctcaaggaaatatctgtatggaaggttcacaattatagcaacgaaatgacgacggataaaaaaatctcagagatg

SEQ ID NO: 118 - DNA, 2138 bp, Saccharum
aaagaacaacgcacaaacaaatgaatccacaaagtttagaaatgcgtacaacctcctaatccttttcccctctttctctggtacagtacactttgccctaaggcgtggaaatgagtgaggcgtggatcatgcagtctaaatacaatcacagcatcaacaatccccctagctaatgcttcaaataggcgtcgagcgaagaatagaaagcaatcgaacatcaggacgagcagaagagctgtcaacaaacaaccacaaaaatctacacagggtttccatctgtaattcacaacttgcctatgggtgttatctgactaccgtgtactcgtcatctgcaacgatccatccttttgcagcttaaggctcaggctggtgaaccgctctctcgaatactgtctcgatgctttcctccagtctgttccggccttcatcatcgccgcaaactcatcgtagcttatcttgccatccttatcggtgtctacatcacggataatggcattgataacctcttcatgattttgtccaaggtcatcagctaatgactcacggagttcatcgatttcaatataaccactctggttccggtcaaagtatgcaaatgccttatgcagatgctcatcatttccaatctttcttagatgaacagataatgtaacaaattctccataatccaaggatccatttccatcagcatccgcagcttccattagtatttgaacatctgcatcaggcatttggtgaccaaacttatgcagaccaagcttcagctcatcgaaactaagcatttgatccttgttaagatccatcttttcaaacatatcctttatgtcagcagcctcttctaccgaaagatgctcagctatgaccctaagtgcatgcttcttgaacttgttcatcacagagaattgttggagtctggccttaacagtttcacccaaattgacatttggagccttcttaatgttctgtaaccatgggtgatcaagcacttgctgagctgtcaatcgtcgttttggatccggattgagcattcctctgacaaggtctttggcgttatcagacacccttggccatggatctcttttgaaatcaatggcagatcggataattgcctgagcaacaccctgttccgtttctgcccagaatggagggacaccacaaagaagaatgtacagaatcactcctgcactccaaacatcaacctctgggccataatttctctttagcacctctggagccatgtaataaggacttccaacaatctcagtaaaccgttcgcctggagtgaaaaatacagacaggccaaaatcaatggccttaagggctgctgattctttcttgttcgcaaacaagaaattttctggtttgagatccctgtgcatcactccatgcttatggcacatctgcacgacctcgacgatagtgcgtgtgaccaaggcggcagcgcgctcagtgtagtgtccccgcgccacgatgcggtcgaagagctccccgccctcacagagctccatgacgaggtgcacggcattgtcgtcctcgtaggtgtccctgagcgtgacgacgttggggtgcttggggaggtggcgcatgatctccacctcccggcgcacgtcctcgatgtcaacgggggtgcggagcttcttcttggagatggacttgcaggccagcgcctcccctgaggcgcggtccgtgcagaggtaggtgaccccgaactcgccgcgcccgagctccgcgccgagctcgtaccgcgccgcgatgtcccgccccgtgggctcccgcagcaccaccagcctgggcgcgctcgccggcgccgcgcggttgtactcgatcgagaaggggttgggcttcttgcccttcttctgcttcggctccttgggctccttgcgcttcttgccgccgccggcgtcggcggctccgttcggcgtcacgcagcagttgcccatccccagccgccgcggagatccgacagccctggagaaggcgaatcaaggaaccgcacggctcgcggagatctgtgaggggaggagaagggcggagatggagagagcggccgaggaacgaacagcgcgtgcgcgtttggtgtgcgcgttgtagggaagcggaggcggcgagcgaggcgaggcgagaggggttaaatcgcg

SEQ ID NO: 119 - DNA, 1209 bp, Saccharum
cccacgcgtccgctaagctactagccagagagcagcagctgctggtctgactctgacatggcgaaggacatcgaagcatcggggcccgaggccggcgagttctcggccaaggactacaccgaccctccgccggcgcctctgatcgacgcggaggagctcacccagtggtccctgtaccgcgcggtcatcgccgagttcatcgccacgctgctcttcctctacatcaccgtggccaccgtcatcgggtacaagcaccagacggacgcggcggcgtcgggccccgacgcggcgtgcggcggcgtcggcatcctcggcatcgcgtgggccttcggcggcatgattttcatcctcgtctactgcaccgccggcatctcaggtgggcacatcaacccggccgtgaccttcggcctgttcctggcgaggaaggtgtcgctcgtccgcgcgctgctctacatcatcgcgcagtgcctgggcgccatctgcggcgtggggctcgtcaagggcttccagagcgcctactacgtgcgctacggcggcggcgccaacgggctcagcgacggctactccaagggcaccggcctcgccgccgagatcatcggcaccttcgtgctcgtctacaccgtcttctccgccaccgaccccaagcgcaatgcccgtgactcccacgtccccgtgttggctcctctcccaattgggttcgccgtgttcatggtgcacctggccaccatccccatcaccggcaccggcatcaacccggcgaggagcctgggagccgcggtcatctacaacaacgacaaggcctgggacgaccaatggatcttctgggtgggtccactgatcggggccgccatcgccgccgcctaccaccagtacgtgctgagggccagcgccaccaagctcgggtcgtcctaccggagcaacgcctaagtccggccgccggacgcgccccaggagctgggcaccgaagtgtagatacgcgcacagccgacgcccgactccgatccctccagtacatgacgccctgttcctccacatctgccagtctctccgtacgttagtagttgtgtcaagcacgtgcccgggtctccgcgctttgtttgctgttttctttttttttccgaaaaaagtgtgatatatctttgctttctgtatatgtatgtatgaatgcattctgtaaggagaatttggaagccaattatgtgagttttt

SEQ ID NO: 120 - DNA, 1445 bp, Saccharum
  misc_feature 1286, 1313, 1333, 1389, 1409: n = A,T,C or G
cccacgcgtccgctcctaccaaaaatcttatgcccaaaagactgtaggaccatgttatgagattagaagatctactagtgggataatttagtaggataaagatctccgtgcagatatgggtttgtgagccggtattcacagccctaggattacaagtggagaactgtacggtggccaatccaagccgttcgcgcgcgatccaatgagatggtcagaattacctcctccttgcttcggagcgctccgataaatttgaccatccaattgtctcctcactcagtctcagctcagggctgaagcttctctccactatcctctttccatgtctccgaacaactgagtgttcgttataactgctgaggttcagagaaagttctaagaagctgggtgcaccgcaggcctgatgcttcttccccctcctcttgcagcctagcagcaatttcacttcacaagggcttcttttttattgaagtaaacggaatcagagtattcagcggcgcatctgttcctgaaacaaaaaaaatcatgatgatatattcagaaataatgaatctattagcttttgtgttacttctgtggggatgtcaacagctttctctttccctcgctatcgaattccaagtcgaagcactggttgaaatgaagatgcaacttgtagataaccgtggtgtccttagtgattggaaggataatcaaatgagcccctgctactgggaatatgttaattgtcaagacaacaaagttacaacaataactttgagctcgtctgggttaacaggaaccttatcacccagcattgcaaagctaacaactttacagcagctgaaactggataacaacaacataactggagggattcctctggagtttggaaacctatcaagtttgacaattctaaaaattggaagaaacaatttaaatggatcgataccggactcccttggacaactttctaaactccaaaatctggatctaagccacaattatttaagcgggaatatcccaagctctttctcaaatcttccatcattgaataacattaatctagcacataataatattagcggtgaaatcccacaacatctacttcaggcggctcattacgactttacaggcaaccacttgaattgtggccaaaatttatttccatgtgaaggaggcagcacaaggacaggtgggtcaaaaaattccaagctaaaggtggttattggaagcattgttggagcagtcactctttttgtaacagtagttctagttttgctatggtggcaaagaatgcgttaccngccctgaaatcttcattgacgtgtcangtcagaatgatcatatgctngagtttgggcaaattaaagaggttctcatggcgggagctttagaattgcaaccacnatttcagtgaacaagaatgntccttgccaaaggttgtttttggtaaggtgtttaaa

SEQ ID NO: 121 - DNA, 1160 bp, Saccharum
cgtccggggaagggcgccgggtacagcttcgacctggaggacctgctgcgcgcgtcggcggaggtgctgggcaaaggcagcgtgggcacgtcgtacaaggcggtgctggaggaaggcacgacggtggtggtgaagcggctcaaggacgtggcggtggcgcggcgcgagttcgacgcgcacatggaggcgctcggcagggtggagcaccggaacgtgctccccgtccgcgcctactacttctccaagaacgagaagctcctcgtctacgactacctccccaacggcagcctctccgccatgctccacgggagccggggctcgggtcggacgccgctggactgggacgcgcgcatgcggtccgcgctgtccgccgctcgcgggctggcgcagctgcatacggtgcacaacctggtgcacggcaacgtgaaggcctccaacgtcctgctccgcccggacgcggacgccacggcgctgtccgacttcagcctccaccagctgttcgcgccgtcgacgacgcgggctggcgggtaccacgctccggaagtggtggacacgcggcggctgacgttcaagtcggacgtgtactccctgggcgtgctcctgctggagctcctgacgggcaaggccccctcgcacgcgtcgctggagggcgacggcacgctggacctgccccggtgggtgcagtccgtggtgcgggaggagtggaccgccgaggtgttcgacgtcgagctggtgcggctgggcgccagcgccgaggaggagatggtcgcgctgctgcaggtagccatggcgtgcgtggccacggtccccgacgcgcggccggacgcccccgacgtggtccggatgatcgaggagatcggcggcggccacggcggccggacgacgaccgaggagagcgagggcgtgcggggcacctcggaagaggagcggtcgcggtcggggggcacgccgccagccgccccgacgccgtgacgcagctagcatgcagggtaaaggttctcttcttggcctgattaaattgcataggttcgtggtgcctgtatgtcattggacagtggtattctgttccttctttgtttttcttttcactctattttttttcttctttgtctttccagggcattgttttgttggatcaaattttcttttttcttcccccc

SEQ ID NO: 122 - DNA, 613 bp, Saccharum
aacctctccaacaactcgctctccggccgcgtcccggacctcagcctccccgcgctccggttcctcaacctctccaacaaccgcctcgacgggacctcgcggggctcgccgcgctccaggtgctcgacctctccttcaacagcttcgacggcggtatccccgctgagctcgctaacctgaccaacctcgtcgcgctcaacctctccaacaactcgctcgccggccgccgtgactttgagcagcagatggagctggttggccggattcgacatgacaacgtcgtcgagctccgcgcctactactactccaaggacgagaagctgcttgtgtacgattattacagcaggggaagtgtatccaacatgctccatgggaggaggggagaggacaggacgccattggactgggaaaccaggttaaagattgccctgggagcagcaagaggagttgcacacattcacaccgagaacaacgggagatttgttcacggcaacatcaaggcctccaatgtgttcatcaacaagcatgaatacggctgcatctcggacctgggcctggcatcactgatgaacccaatcacggcaaggtcccgttctcttgggtactgcgcacc

SEQ ID NO: 123 - DNA, 1028 bp, Saccharum
cggacgcgtgggcggacgcgtgggtttttttttttttttttttttttttttgagttatgagaacttcacatgaaaactcacggaatctgtgaccagcatattttataaaaaattgagttcttgcagccacaacttggatcattttacttccttgcctaggcatgcacaactagccatgagaatacccttattattacccggccctacggcatcgatcaggcatggttttaatgaagggtccggaaaattataacaaatagacagaaaaaaaaatacgacagagaaagccaccaaactcctaattccccccactccagtctccagggatcgatgaacaccaaagtccaaagtccaaacacatgcatgcatgcgtaatgacagtcgccgcgcgcgtacgccgatcagatcagtacaaggggcagttgagccggggcgtgggcacggcgtagagccttgtggcgcgtggcgcggtgaggccgaagatgtcgcccatgtccagctccgacggcttcatcccgtcgggcagcgaccagttgaagccgtgcgcgagctgggcgacggcgagctccagcgcgtacaggcccagcgccgtgccggggcaggaccggcggccggagccgaagggcaggaactcgaagcagccgcccttgaagtcgagccccgcggcctcgccctcgggcgtgaacctggacggccggaacacgtcggcgtccttccaggacccgcggtggcggccgatggcccacacgttgatcatgacgcgggagcccttgggcacggagtagccgcccacgacgcagtcgtcggcggtctcgtggaggagcagcgggatcggcgggtgcagccggagcgtctccttgatgacgcacttgaggaaggggagcttgtccaggtccgactcgttcacgttccggtccaggcccacgacgtcggcgagctcctgctgcacgcggcggaggtcgtcggggctgtgcatcatctccgacatcgcccactcgatcgccgacgccaccgtctccgtcccgcca

SEQ ID NO: 124 - DNA, 1249 bp, Saccharum
gatgctattgcttcactgtattctgtatagttcatattgtacacaaaatattaagccgacaggcgccagtagtgccatgctcctcgtctctcaaacttgccgatggtaggggtcctacctatacccgaggtctagatggtgctgatatcaactttgctcttaacaatttggaaggcaggagtaacccagctgccacagttgcactgtattcctgcccagttgaagtatcccaaccgagctccacagtggatgcatgatagctttccttccaaagcactgtcttctactggagtcatccatttcagaggttcgacaaacaaagatgagcaatcttgttctttgttgttgtatggatgaccactcttccttcggttccaatcaaagcaagattcaccctcaccaggaacatgacttacaacattgtcctctacagcaataactctcctgcatttcctgcagcggtaagctgttttacgttgctcaacctttgaagaatcttgacaagagccagactgcggagcaaggccagggtcatcttcaaacatatagctgcctattttctccccaaatttgtaggattgacctaataattttaagcggaatctcttgtacaaaggacttgaagtatcaactttgaagcccatttcttcaaacaatttcagctggtcaagaaaaccatcattcgggcacgccgactcagaaatctccttcaaagcttctaatgcatcttcaagagatttctgttctgatctcataagataagcaacaatgatggaagcactcctcgacaccccagcaaagcaatggacgaggacattcccgactttcctgccctcatcgatgaaatcaaggcagggctcgaggcggtcgagcaggtcctcctcctcggtgtcccgcagcggcacggccatgcgcgtgacccgcagcccgtgcccggcgcgctcgaccacccgcatcagcgtcccggggggcaccgcggcggccggtggcgcgccctcctcacccgcgacgacgcggcggacctcctcggtggggatcgcgaggcccgggcggcagtcggtgatgaaggagatggaggcggagctgaccacggagaggacgtgcgtgaagtccggcgtgggggaggactccgtgagggcggcgatggcgtctttgatgtcgccgaagtagagccgctcgcggacgaggtgcggcatggcggcggccggcggcggaggcagtgaccgctggtgagagtcagtgaaatctg

SEQ ID NO: 125 - DNA, 608 bp, Saccharum
aagcaacagcatacgtattgtttctgatgatagtatatattttctcaagggtgattcgaagcagagcaatgtactaagctacagatcacaaggaacatcaacatacaccagattcttttccacaacatatgaactgaagctgcaaatcaaatacataagcacaatcgtaacaaaaccagtttgtgcaaacaagttgcaaacaacatgagtcccatgcaggatggtagaatttattaactcgatctttagttgttggaacatgccaagcattgaatcaccgtcagcagcgagtagggaacttaatgtgaagacgacgatgacgatgcctcatgcccatgtccatgaccatgagagtggtcatcatgcccatcccaaggatgacgcaaacccaagagcgtggcaccgtcctgcttagccctgtagaagacccagaaccacatcacggcgcagaggcccttgccggcgacggtgtgccagcgcttgttgtgcgggattgtgtagcccttgtaggtggtgccgccatgtgcgccgccgccgcccatcgccgccgactgctcccctcgccttgtcagtcgtcgcgtgtgctcgtgtatggtgcgggtggtgat

SEQ ID NO: 126 - DNA, 1345 bp, Saccharum
  misc_feature 21: n = A,T,C or G
ttttttttttttttttttttnaacgttttaaccattgagcccgatgttttatttcaaatatatttagggtctatctacatatctgttgacagatttttacaccaaaaatctgtcaaattttagacaaataaaaagttgacacatcagcaagaaaaaactgacagatgctacaacaaaaaatttgtcagatttttattacacaagacatatccaacaaaagatccacaactcgttaacaaaaatacagctgacttgatgcatgcctactgctcactgcttttgctgctgctggtcactgcactgtgctcgctgctgctgctgctccctgcgctgtgctcactaacaaatgcagtggatgcaaaaccttgtaattctttggcttggtgaaaaactgcatagttgatttcggaccaaattgtcaaacctaaacattgcccattgcaatgagccccttatcaaagaagaaaacgattcccagaaaggagaagaatattccaaatacctgtcaggccaagcacaatctcttgggttgtagaaaattgtaaaccagctatttgtcgaagcaacatgagcagctacggcaagaagaccgatatgcatgcataagacaaaagatggcatgatagtttgtggccaatttgcccaacgaattcccagcagaaggtggttattgtcattccagataaaaaggacagagtcaccagctacgagtctctttgcacttacaaagacactccagcctgtagttagaagatgttgctttggctgaccacgaaagatgtgatggaatttccactcattgccatgaagatcttttgccatcaactcctagaatggaggttgctgggtgaaatctagtggaggaaccactttcctagctgctcgacagggaacagagaaccaacaattattgttacttgtgtcacttgctgttaatattttgcagaaatagcttgttggttgtttattggccgaacctaactctgtaggtaaatataggtccttcagttcttgcgggttgagtggttgcagtgtcatctgtgcatatacctcatctgtctttgcatcagcatgcatcgtcacataatgcagttggcatataagctgtggcggcaaattaggataattggggatctgaggctctatttccttgtttgttgatgctgctacctgctcgctgtggccatgagggaagtacacagctaggctacccactaagggaaaggaaacaagcgggccggcacaggcatgccacaactctgagttcacgcacttgtgctcctccacacctgtaatggcagaagtatttgttttgttttgagaacaagtttcaatactgcaagtt

SEQ ID NO: 127 - DNA, 2287 bp, Saccharum
aacaaacaattgatcgattacattcacagcatcttctccttttttttcaaatgcaccagaggaattcggatgtttaaaatacatgcaacatgtatacaatcgaaatatacactaaattacatgatttaaaccagacggcattagagcacctgatctgtctatctacagcatccaatcttaaattgtgaacaattttaccggttggatcatgaatgcctgcttgctacagggtccaagttcagctatcttcagcgaagaagttgggttctgctggcttttgtaacagtcttgcaggtactctttcctgcaaacgggcctttctggtggcgtttctccgtaagatccgcatcatgttgccagcaaaacgtgaagcatagagcgctgcaccaagactgagcgaagtagtgccgtcacttacaattgctgcttgtaacctcttctccttctcatataaagcctcttccagcttctttctgcagtatctgtgccaagctgcctgtatgaagcaagcagcccaggtcctccattgctgtgagtaaaatcggaaggtatgtcggagttgtttgctgtggagcctcctgaattgcgtggcaacaaacttcaagtcatcagccctcagagcaaaagcttcaacttcagacaacgtcttcactgtcctagttgagccaggaagatttgaagctgaagtggggtcaagggcccatgtgaggagctcttcaccacagaagtctccaccttttagaacattagagttgaagaagccagtttgtccaccatttgttgtggtactctctagtgttcctctcatgatgaagagcatttcattcactgggtcaccttcgcgaatgatgcagcttccttctgtgtacagcataggcttcagacgatcacacatggcatccaacaattgttcatccatgttttcaaacattggaaccttcatgagaagcgacaaacaaagatgtctctttatctctcttctaagatccttgggaagatttttaagaaggccctcttcgtcaacccctcttgtttcttgccacctatattgttcatggcgcataatccgatccttgagattctcagggagtaacctatgtgccatccactgctctgtatcacgccttttcactctcatttcttctatacgcacagaagctgactgtaaataggtctgcacattaccaataagtagtgcaaatagaaccaaacccgatgtcgagacaaaaacagcaaacagattctccaaagtattagtgcttgttttcatgttctggccaagggaacttagattctgtaggccccaccaaaagcaatagaatagtttttcaaagaaactcgttgattgtgaaacattttggagagctggtagaaagattccaaatatcgggtctggattgggattggaagtgctatttgttgggcatgcactttgtaagaaagaattatttgtaagtggatgatacccacagtataaagatgtaagctcacagccagtctgattgatacatgcttgtctccaacaggtgtcttctcgctggatggaaagaatgtaccaaagagctccaaagccatgactggcaagcatataaattataaggttgaaagcagcaccagcccatgctgtctctgtaagtatgccagcagatctcgtgatttgaaggtaaagtggtattatgcggagcagtcgaggcacatactgacaaataataataaccagtagtacattttttgccttcataacttcaggaccttggagagtaggcagcaccaccaacacaaacacctgagggaggggcagaactgctaagaaatctaccaggaacagtgttgatatatatcgctttgctattgcaaatgtgtccttaaccaagacaccccgaccgaacactctagaagagggagcaataaagcctgttctgaactgaaatagcatatggagtaaatagaagatatctgtgaaaaagcgcaggatacttgctacggtctctaacttcttgtccaagtacaggcagttgttgccaccatcaattactgggatatacaagaacaatgggtccacaaaaactgcaaaaagacatgatatcacaaatatcttgttccatctctgcaaaaatggcccttgaggatcaagaactcttgttttggacttcttttcctctgggcctgatttgtttagagcttcagaatgtgaagagttccccaggaatgaaaaggctcctgcagttctgtcctttaacaagccaaagatgttatgccctctttctgaatttaccctatctgaaat

SEQ ID NO: 128 - DNA, 821 bp, Saccharum
  misc_feature 655: n = A,T,C or G
ctccttcttgccgcacacgcgagcgcacgcagcaaccgagcgctgctagcgagacgtagagcgaggctgagcgccgagcgccactagcgagagggcagcgccgagcaccgagacgacatggagcgcttcgcggcgaccatcctcttcctcttcgcgctactgtcgggaggaggagcggcggcagccagcgacgggtgcgagtcgcccatgcgcggcgccgcaaagcaactcgccgccgccgccgccggctgcaccaccgccaccacccactccgcgactggaggcgttacggcattggcaggacccacgtgtgatgcaccgcttatagcgtctcagttgactaagctctgcagcgttgagctggatgctcccggtgctctgtgctgcactgtggtcctgatgaccgtggagcaggacacagactgcttgtgttgggtcgccgacgagcccgagttcgatctctctgatttgtcagttgcaaaagtatgggggtggtacaagagctgcggggggcgccgtagatcggtacctcggaacacgaaccgctgcgagcctgggtcttcgccgccgccgccgccgccgccagccaagcccgaggcaccttcggcttggccattgaggctgtggcttgcagtgtggttgctgtccgctgcancccgtcggtgccatcatctttggtgccctcaaactatggcttccgcggactgtacaagtgacaccaaggatgcagggtcatgatcagggggcaaagttaaatctgggtcaagaccaagatgcagcaatgacaggcgagcctccagtgacttcaggccaaggggatg

SEQ ID NO: 129 - DNA, 1324 bp, Saccharum
gacaagtttcccatcctttatgaagttccagacctcatcaaactagatcatttgtgtgttgtgcaagctcccttgtagtatccaagaagattttcatctcaggtaggcacagaagatggataagcttgtagatatcttctttactgtaacttggatactcttgattaggagaaagattatcctccaggtaattatgcaagcaagtgttatcaactgcaatatggagtgggagtaggcccttggctgtgttgccagccatgcgtacattagctgacgcacctttgcgtatgagcaacttaatcatctcaacagagaaagttccagcagcttcgtggagggggaagtgcccatatttgttcatgtggctaggagggccaaataccttttcataatgtcggcacttataggggcagaggtttccaatattgatgatttcttcaggagggcaaaatccaaaatccttcagaattgatgaaacacgctcaaggacatccacatgcggagcctctgaatcggacgcgtgggcggacgcgtgggcggacgcgtgggcggacgcgtggggctataactccacaagaaagaagctagcacagtacttagcatcaatggccgcctcctcgtcgtcaatcctcctgctgctcctggccgccaccctgatggccggtggcgttcacgcggcgaccttcaccatcaagaacaactgcgggttcacggtgtggccggcggcgacgccggtcggcggcggcacgcagctgaaccctggcgggacatggaccatcaacgtccccgccggcaccagctccggccgcgtgtggggccgcacgggctgctccttcagcggcaaccgcgggagctgccagacgggcgactgcggcggcgcgctcgcctgcacgctctccggccagccacccatgacgctggctgagtttaccatcggtggcagccaggacttctacgacatctcggtcatcgacggcttcaacatcggtatggccttctcctgcagcaccggcgtggcgctggtgtgcagggactctgggtgtcctgatgcgtaccaccagcctaacgacatgaagacccatgcgtgtggcggcaacagcaactaccaggtcaccttctgcccgtgatgacgaggcaaaatgtagtggttgagacatgtatgtgatgacgaataagacgtgtcgtgataacgtgtccaagcgtgtatgcatgtgctcgcatatgtatcaggacttgtgtacacgtacaatacacgtaccatatgtatagctactagtagtatataaaatacaaataagtctatgctcttgtcatgttggaaagc

SEQ ID NO: 130 - DNA, 517 bp, Saccharum
cgggtgagagagcggcagtgggtggtggactgacataatcaagggcgcgggacggcgggaggaagagatcggcaggggtgactgagtggcggaagtgccaccggtgcccgtaggggcagacgacgccagcgagcaccatgcggcagacctgggtcttgtagcgcggatggcggatcacagggcggagctcgccgatgccgtgcgcgaactggcattggtcaccgtacgggcacgcgccagtctcctcccacttattgcacagctccgtcttcagcatgccctggttgtacacctcgaactccagcccgccgttgagctccttctcctcctcccccttcacgccgccgtccatgcccacgaacacgcgctgcgagcccttcgttgtcttggacgcgcgatgcttgccgttctggttcatcttgaggtagccgggcgagcggacggagatgctcttcggcatcaccggtgcgacgggcagcggtgacggaggaggaggtggtggtggtggcgcggcgtg

SEQ ID NO: 131 - DNA, 738 bp, Saccharum
cagcatcgggatcgacctagcctcggagaacatgggaggtggaaaggacaatcatcatgctgacaaaggatgctatccccctattggctatcctccagtacattcaactggatcatatgcagctgcacctccagttgcatatccatatccatatccatatgcacatggatctatatgtccaccaccattaggatcatatccatatccttcacctatgtactcttcgcacactaggtacccaccatctggatatccatcatacactcaaagtgtttacccatcaatgggtggctatcctggtgctagtttatatgctactcaacatcatggtcatggatctaacatgggggcaacactcgttggtggagcagcagcagccactgccgctgcctatggtgtacatcacttaacccatgggcatcacccttatggtcaccatttagggcattttggcaagtttaagcgtcatcatcatggacactatggaaagttcaaacatggaaaatttgggaagcacattgggttaggaggaaaacatggccttctaagggtggaagcatcaccatcatgggttctttggaggaaaaatacaagaggtggaagtagtcaaattataggctacggtatgcaattggatcgtgcaagtatgataattaacatatgtatataaaaatgggttggttcatattaatgttatacgcacatgtattgcttttatacattacttgttatatgtgt

SEQ ID NO: 132 - DNA, 2217 bp, Saccharum
caaaaagagggggcgcaagcaagagaaggattaggacacgagaactagcatagcacaagagggaagaaaaaagcttgagagagagagagagaggtggtgctggtgccgcggtggtggaggtggagttggatcgggctgtgcggatcggaggaggtcatgatcaactaatgcccattcatctattatggacttgcaccagttgttaaagtacagattaactggtgataacgtcttctacgaatttcctacagagaacaacttagcaaacactccttggccagctagtccactgaagtctgagttcagcagctccccatacactcctctttcatcccagcttgagtgtgataatttgtctgctctcagcaatactccagataaccagagctccacagaaaccatttcagcacaaccaatatcaccactggaagtagacagctcatacagacaagcagctatccttcgggagaacacccaagtgagacctgatccattgtacgcaacatcaaggcataatatgcaacacgctttacgggaaatagagactgttctgatggcacctgatgctgaggatgcagccactagcaccaagcatgaatttgtggaacataaacctgctcagctgatgaggcagcggtcgaggacatggagtcatgaatcaaggcagccatcaccaggagttgtacggacacaatttgcatctggataccccacagcaagctatgaattccgcccagagaaacggctaagggagttaaggggggatccgcagagcatggtgaagcagctattgaccaagtgtgctgaagcattaagtgaggagaggatagaggagttccttaaccttgttcagcaagctcgtgcagttgtatcaattactggagagccaatccagcggttaggtgcttaccttcttgagggtttggttgctagacatgcaaactcaggtacaaacatatatcgtgctctgaagtgccgggagccagagagtaatgaactcttgtcttacatgaagattttatataatatctgtccgtacttcaagtttggctatatggctgccaatggggcaattgcagaagcattaagaaatgaggacaaaatccatataattgatttccagattgctcaagggacacaatggataacactgatacaagcgctcgctgcaaggcctgggggtccaccacatgtgcggatcactggaatagatgatccagtgtcagaatatgctcgtggtgaaggtctggaccttgtagggaagatgttgaaaagcatgtctgaagaattcaagatacctttggagtttacccctctgcctggtatttacgcaactcaagttacaaaagaaatgctcgacatcaggccaggcgaagcacttgctgtcaacttcactctgcagctgcaccacaccccagatgagagtgtggacgtgaacaacccacgggacgggctacttcggatggtgaaaggtctgtctccaaaggtgaccacacttgtggaacaggagtcgcacaccaacacgaccccgttcttgatgcggttcaccgagaccttggactactactcggccatgtttgagtcgatcgacacgaatctgccacgggaaaacaaggagcggatcaatgtggagcagcactgcctcgccaaggacattgtgaacatcatcgcctgcgaggggaaggaccgggtggagaggcacgagctcctgggtaagtggcggtcaaggctgaccatggccgggttcagaccatacccgctgagctcgtacgtgaactcggtgatcaggaagctccttgcctgctactcggacaagtacaccctggaggaaaaggatggcgcgatgctgctcggctggaagaacaggaagttgatatctgcttctgcgtggcactgactacaagttttcaggaggacagaagtaaacatcaactcttacatatgaatatatatatatatatatatatatatatatatatatatatatatataaattacttggtctgctttatcagaaaggatgccctttgttgtacatgtacatgatgctgtacccttagtttttcctaaagtgcagaccagagaacattgacattagattgtagctgtataattttcttgtgctctcatgtattcacccctgtcatagccttccggtatcttcgattacttctccaagggtattcacccccgatcagcaaacctactgagatgctt

SEQ ID NO: 133 - DNA, 1261 bp, Saccharum
acccacgcgtccggcgaaagacatcagtcaagagcgcgagttctagtagctagcctgctgatctgctgtgttgtttagttgggaaagccatctgtttcggcgatcatggaggacgagaggaacaccaagcagcaccagggcggtgaggcccaggagaacgccggcgccgatcaggtggaggtgaaggacaggggactcctggacagccttctcggcaggaagaagcacgaggaccaggagaagaagcagcaggaggaggaggagcagctggccaccggcatggagaaggtcacggtggccgagcccgagaagcacgagcacaagaaggaggagcacgaggccgccggcgagaagaaggagagccttctcgccaagctgcaccgcaccagctccagctccagctcgtcgagcgacgaggaagaagatgtgatcgacgagaacggcgagatcgtcaagaggaagaagaagaagggcctcaaggagaagatcaaggagaagctgccgggccaccacaaggaccacgaggccgaccaccacacggccgtactggccccggcggcggcgcccgcgcccgtggtggagacgcacgctcaccaccaggaggaagagcacaagccgcacttcgcgggcccggcgccttccccgcacgtggagacgcacgtccaccagcacgaccacggcgtcgtcgtccagaaggtcgaggacgacgtgaagaccgagaccccaccggcaccggaggaggagaagaaaggcctgctggacaagatcaaggagaagctccccggtggccacaaaaagccggaagacgcttccgctgctgccgcaccggccgtcgtccacgtgccagcgccggcgccgcacactgaggacgtgagcagcccggatggcaaggagaagaagggcttgctgggcaagatcatggacaagatacccggctaccagaagagctcaggtgaagacgaccacaaggacgccgccggcgagcacaagaccagctcctaaggtcgcaacgtgtcctggtcgggccttgatccatcagaagcgttggcgtgtgttttggttctggtttgctttttaagaagtttgtttcaaggtggatcgcgtggtcaaggtccgtgtgctttaagccccaaccggcactggcagtgagtgttgctgcttgtgtaggctttggtacgggctttagtttggttccgagtcagggattggatgttgtgtacttgggtttgttgaattattatgtttattagttgcgtattgt

SEQ ID NO: 134 - DNA, 1261 bp, Saccharum
gtcaagtttgagattgattggcttcttgaaatatgagttgagcaattatttttggaccgaaggagcaaccagtacatctgttttgacgtggtatatacgtatattgcgtgcagatccagatgacgagtgtactatatcctgaggctctcgatgaaccgtgtcccttgctccagcgcattgaagttccccttgatgtactcctctatctcaatggatttgtaccgcgcgtgggtgccctcctcctcgaggagccccggcagcggcgccaccagacccccgacggacgcctcctggaatatgacgacggtggtccggcccctctcggcgtccgggatcaccctgtgctcgacgctggcgtaggcgccgttggtgagcacgtccaggatgtcggcgacgttgacgacgaaggcgcccggcagtgggcgcacggggaaccacctgccgtccttccggatctgcaggcccggcgtgtcgtccacgtgcagcagcagcgtcaggcccgggccgtccgtgtgcggcgtgatgcccatcaccttctcccggtggcggcacggagggtagtagtggatcgccatgctctgccgcttccccgtgaaggcgtccaggagtgcctcctgctccacaccaagatcggccgccatgaaacccaggagcctcattgcgaggtcgatcatctccaccgagtaaacctcaagcgcgtccctgaacgtgggcggatttgtaggccacatttccatgttcctgtcctggggtggctgcgtgacgaggatcatgctctccgcccagtccagcttgccactggacgctctgctgtagtggtgcccaaatccttcgaagccgtttcctcggaccgccactttggccttgctttccagtggcaagctgaagaactgcacggtattgtgtttcattcgctgtaccacttcttcgtcaactccatggtttgtcagctgaaagaaaccccagtttctgcaggcatcgccaagcttggcgatctccgacgccgacagctccgggtcgaggagcctggccatgtcgacgaccggcagctcgtagctctcgtcctcaccgacgacgacgccgtcaaggacctcctcggttcggacgtacttctccgggatctgctcggggttggcgaacgcggaagctgcagcatccgtgatctcattcctgttgacaatactgtcgtagttaggagcctccattgctgtgcgtctgctgctctgctgcacctagctccgactccaactccgatcgaatt

SEQ ID NO: 135 - DNA, 1315 bp, Saccharum
atcagaacacgatcgagcgagcacctctagcaagcaagctcctccgacctatcatcatccatggcgagcacgctgaaaggcctgaccccggtgcacgcgtcatcgatcccggactgcttcctcttgccggccgatcaactccgcccagccaccgccgctgtctccctgcccgtcgtcgacatgtcccgagaccgcgacgaggtccgccgcggcatcctcgactctggcaaggagtacggcttcatccaggtggtgaaccatagcatccccgagcaggtgatgcgggacatggaggcggtgtgccacgagttcttccacatgcctgcggaggacaaggctattttttactctgaagacaagagcattcgcaacaggctcttctccggctccagcttcgagaccctcggcgagaagtactggctggacgtcctggagctcctctacccgctgccctccggcgacacctcactctggccccacaagccgcagaggctcagggaggttgttgggaactacaccgggctggctagaggcctggccatggagatcctgcagctgctgtgcgagggcctgggcctccgccccgacttcttcgtcggcgacatcagcggcgcccgcgtcgtcgtcgacatcaactactacccgccgtgcccggacccgagcaggacgctgggcctgccgccgcactgcgaccgggacctcatgaccgtcctcctccccggcgccgtccctggcctcgacatcgcctacaagggcggctggatcaaggtcctccccgtgccaaactccatcatcatcaacttcggcctgcagctcgaggtcgtcaccaacgggttgctcagggccgtggagcaccgcgccagcaccaactcggccaagccgcgtctctcggtggcggcgttcatcgtgccggcggacaactgcgtcgtcggccccgcggaggagttcgtcagcgaggacaacccgccgcgctaccgcaccctcaccgtcggcgagttcaagcgcaagcacaacgtcgtcaacctggggtcctccatcaaccaggtggccgacctcgagaacaaccagaaggagattatgtgagagctagcagaaccgcaacctggggttactacatgatgtatcagctgagatgtatgtacacttgtgacagtgacgcgtcgtttcgtaccggccgtgttcctgatacgtacgaaccaataaaagccacaagtgataagttatctattatactccctcctttatcttttcttaggcacgaggaccagttttacagagaccaagaaattccaaagagcaagaggggaaattaatg

SEQ ID NO: 136 - DNA, 2141 bp, Saccharum
acgggccggaagccgacgcagacagaccccagcagtgagagcaggctgacgctgaccgacggcgacgtctacgtgccgcgcgacgagcggttcggccacatcaagaactccgacttctatggctacacgatcaaggcgttcgcggacggcctggtgcccatcctccaaggctacttcctcggccttgagttcaactccttcaaggacattctccagctgtacgagggcgggatcaagctgcccgacatccccgcgctcgaggagttccggaagcagttcccgctccagatggtcaaggacctcatgcccgccggcggcgactacgtcctcaagctccccatgcccaaaatcatcaaagaggacaagaaagcttggatgagtgacgaggagttcgcaagggagaccctcgccggcgtgaaccccctgatcatcaggcgtctcacggagttccctccgaaaagcacccttgatccgagcaagtacggcgaccagacgagcaccatcactgaggcgcacatcgcggggagcctggagggcctcaccgtgcagcaggcgctggacagcaaccggctctacatcctggaccaccacgaccactacatgccgttcctgatcgaggtcaacagcctggacgacaacttcatctacgccacccggacgctgctgttcctgcgcagcaacggcacgctcgcgccggtggccatcgagatgagcctccccgagctccgggacggcatcaccgctgcgaagagcacggtgtacacgccggtgccggcgacggccggcgcggaggcgtgggtgtggcgcctggccaaggcctacgtcaacgtgaacgactactgctggcaccagggcatcagccactggctcaacacgcacgccgtgatggagccgttcgtgatcgccaccaaccggcacctcagcgtgacgcaccccgtgcacaggctgctgctgccgcactaccgcgacaccatgaacatcaacgcgctcgcgcgacagaagctcatcaacgccggcggcatcttcgagatgaccgtcttcccgcgcaagtacgccatcgagatctcctccaaagtctacggcagctggaacttcgccgagcaggcactccccgacgacctcatcaagcgaggcatggccgttccagatccgtcgagcccctacaaggtgcggctgctgatcgaggactacccgtacgcgtcggacgggctggccgtctggcacgccatcgagcagtgggtgacggagtacctggccatctactaccccaacgacgccgtgctgcagtccgacgtggagctgcaggcatggtggaaggaggcgcgcgaggtcgggcacgccgacctcaaggacgagccctggtggcccaagatgcagactgtggcggagctcatcaaggcctgcaccaccatcatctggatcgcgtcggcgctgcacgccgccgtcaacttcgggcagtacccgtactgcgggtaccacccgaaccggccgtccgtgagccggcggcccatgccggtgccaggcaccgacgcgtataaggagctgcagaagaaccccgagaagttcttcgtgcgctccatcaccacgcagttccaggccgtcgtgggcatctcgctgctggagatcctgtccagccactcctccgacgaggtgtacctcggccagcgcgacaccaaggagtggacgtcggacgccaaggcgcaggaggctttcaagcgattcggggcgcggctgatcgagatcgagaaacgcgtggaggccatgaacaaggacccacgctacaagaaccgctacagcgaggcccagttcccctacacgctgctcttccccaacacctccgacaacaagggcgacaacgccggcgtcaccgccaagggcatccccaacagcatttccatctgatctcacctgcctcaggacagggcgtgacttgcatgcaagcagggaatagctagcgctgattcccgtacgttatccgtttcattttatccacgattgagaagcatgtgtggcaataaaaggtccttacgtgcgcgccgcgcattgtgccatagtgttgtgtgctggcggttaccacttaccagggatgcttgtaatatttccttttggtttcccaataatgaagtcaatatcctggtcaa

SEQ ID NO: 137 - DNA, 780 bp, Saccharum
ctccgtcaatcccaaattccccatcgcgaagtcaccgcaccgtcgccgcgaaagccaacgaagcaaggatctcccctcccgatcgtctcgtcaagatgcagatctttgtgaagactctcacgggcaagaccatcaccctcgaggttgagtcctcggacacaattgacaatgtcaaggcaaagatccaggacaaggagggaatcccaccggatcagcagcgtctgatctttgctggcaagcagctcgaagatgggcggacactcgctgactataacatccagaaggagtctaccctccaccttgtgctcaggctcaggggtggcatgcagatctttgtgaagacccttactggaaagaccatcacactggaggtcgagacctcagacacgattgacaatgtgaaggccaagattcaagacaaggagggcattccaccagaccagcagcgcctcatctttgccgggaagcagcttgaggatggccgcaccttggctgactacaacattcagaaagagtccacccttcaccttgtgctcaggctaaggggaggcatgcaaatctttgtcaagactctgactgggaagaccataacacttgaaggtgagtcttctgatacgatcgataacgtaaaggcaaagattcaagacaaggagggcatcccaccagaccagcagcgcctcatctttgctgaaagcaacttgaggatggccgcactcttgctgactacaacattcagaaggagtcaccctccacttggtgctccggctccgaagtggtatg

SEQ ID NO: 138 - DNA, 1169 bp, Saccharum
agcgcactcccgcgaccactccgtgccgcgccgcatctcggccaccagccgcgccacggcgccgtccagcgccacgatcgcctccgcgccgccgcgcttcgccagcgacgccagcaccgcggtcgcggcctctgcatcgccgatcgcggacagcgccgcctccgcggcgccggcgtcaacgatcctcgggacgttctcccgctcggtggacaggcacaggagcgccgccagcgcgtccttcttggtgctggagggccccgtgcgcgcgagccgcacgacgctgtcgacgacgcgcgggttccggccgagccggcggcggtacgcgtggacggccgccaggctgaggaccgtggccgcggcgttctccttggcgcgccacgtggcgcccgagcccatcacgtggcagagcgcgtccacggcgccctccgcgtgcatgatgcgcttcttgttggcctccaggatggagaggttgagcagcgccgtgacggcgttgagctggagagccgagtcctcggaccggagcagcggcacgaggagccccgcggcgccggcctccccgatgaacttgcggttgtcggacccggacttagccagctgccggatctcttgcaccacgcgcttggtcgcctcgggggagaaagacgtagacagcttcttcacgaggaacgacgcggtcatgcgcgccgccttctgcgcggccttgttcgcgcctaccaccaccggcgccggctctgctttcccagactcgctgctctccatggggatgccgttctcccggcaccaccgcgatatcaagttcttgagcgccttgttgggcacgagctccagattcggcagcacctgcccggtcttggggcacgtggatttgccggagccgaaccaccgcgtgatggagtcgcggtcgtacgtctgaccgctagaagccacaacggggtcggccatcagctcgagggagatggggcaccggaagtccagcggcggcgacggtggctccgcgtcgtcgccgtcggcgtcgtcgagatccaccttggagtccacgggccgcggcgtggcggcactgaagaggacgcacttggcgtagcggaggaggccgacgagggcgatcatcgacgacgtccacctctcagcgacgcggtcaccgatctcccgctccagggtctcgatctcgt

SEQ ID NO: 139 - DNA, 1597 bp, Saccharum
acattgtttcacattgctaccactacagctaaaatttagatgatgatacagctgatccatcttacaacacaaggagaagacaatcctgaggaaacacagcaaggcaaggatgtacaaatgtaaacaccacatattgatagaccttacaatagaatgacaaatcctagtgcttgcctgataaaagatagagaaatgattctaatcgacctgattattccattaaagcaattcctatcatatttggtatctgacaagcacctactcatcacataggttcaactagtttgctacaataagctcatcttcaggattggcattttgaggttgcatcgtcaattcatcatcagctgcactgaaatgatatttctctccaacagctctcagaagctggtaaacttcaaacattgtaggcctttcctttggagaagaaagcacacaagagcaggcaaccttcatgcattgaagcagctcagcatcgttgcccttcccaatcaaagacttgtcaatcgcatcctgaagtatagagttgtttgacaggtaagttatccaatccaccaaactccctttgaagttctctggtgcatttgacacatgtgtgggcgcttcacgagtaacaagttcaagtaagacaaccccaaagctatagacatccccttttggagtggccacaagagtgcgggtatactctggagctacataccctaagtcaccaaactcaccatttacaaatgtgctcaggtgggtgtcaatgggattcataagccttgccagaccaaaatcagaaatcttagggtcatagtcatcatcaagcaatatgcacttggaactaatgttcctatgaagaatgcgagggttgcaactgtgatgaagccatgccaatcctctagcactcccaatggcaatttttagcctcaatgaccattttaatgcctttttatcactgttttgttggtgtaaattatcataaagcgagccctttggcatgtacttatacaccaagagcttttcattcttggcaatgcaatatcccaaaagtggcaccaagttacgttgccttacacttcctagtgttgacatctcagatgtaaattggtcctctgaatgctgagtgtcctgcaacctcttgatagcaaggaatgaaccatctggaagtgttgctctgtacatagttcctgatcgaccagttccaataatattgtcctttgtaaaatcatctgttgctttcataagatcattcaacttcatctttgaaactgatttctcaaacattgatacctttgctccttttgctcccttaatagtctttgcccacttattttcttttacatcctttaacttcttctttgcaggcattttccgcaagacaatgaataaaataacagcaactattattaaagttataactgcaccaccaacagcagaaccaacaattaccccagtttggctgcttgaattggcagtgcaatcattgcttagaggcctcccacaaagatcttgatttgcaaaattggaggctggaaatttgcttaaagatgaaggaatctgccctcccaattgattgtcagcaacattaaactgggctaggcgattgagcgca

SEQ ID NO: 140 - DNA, 1011 bp, Saccharum
aacgcaaaaatgggataaccagtttattacttcacgtcgatgatgtgcccatgagcaataaaatatgaatgaaggaattttacagagagaattctcgcctacgaacaaagcagcctgaatcactttcatttctggctgcgtctaacaaaataatcagttaagcacgatggaaccacgactaaaattgacactatgttgttgcctaatgcttgcctgtgagtcctatatcacaatccctatttgtagcatgaagaatgagatcctagtcctgcactcaagctctaggaaaattgcaatgctaaatcgctcagcagcctacacaactgttgaaatctccagagttctgcaaccaagcgttgaacagttacttagtgtcttcctgcaaaatcaatagacacggcctcggcaattgatagctccacaatggcaggggcagccatcgcctgctacaagcttttgtcggtaatcataggcgagttcttctcctacggcaatgtcttgattagcaaacaagccaatgtgagcaagctggcaatctttgctctctacccaaaccaatcgggtactgagattcggggaacaactgtgattaatatagcgggaagcatttccagaccttgtggcatcaatcaagtattcaatagcccctacagtccgaactctttccctatcaatctgagaagcaatgtcaaacaagtaactgcacccaccctttgacgacacactttctgcatttttcatggtcttgtcggccttcacaacttcaccaatatactcgcagacaaaggtaccatgtggaataggttcagcagctctaatagcccaacccttattctcagttctgaagagttctaacttaacaagcagccctttctgcaatactttattctggcaggatgagtcacaagtacatgatgaattgcactcatatattggatacccttcctgtaaaataattttactatctttagcatatgcaaatctgccatgcattggtgttccattgatatc

SEQ ID NO: 141 - DNA, 730 bp, Saccharum
gcttccttagttttcacctgcctcgctgaaccatttcctccaaacgagtatggaaaagacaaataccttgtcatacagtttgtctaatagtgtgaaataggcatacctccacattttcttgagcaaaaggcaacaaaacaccatccagaggcccaccacaaatccaacaagtaaaccaagatacaagtccattattcgagctgagccatcttcatgatgtctgatgggatgctccacaatagttggttgatctccggggcattgctttggaagtggatgtccacaaagaccaggattgcctatgtacatggaagccggatcatcagtgttgagagtatctagttgatttccagagggtattctgcccgataaattgttgtaggacaagttcatataactcagtgatgtcagatttgataaatcccatggaatttcaccagaaaggtggttgttggagaggtcaagagattccaatgattgtaaagttccaatctgttccggaatcttcccactcaagaagttccacgacaaattcaaatttatcaagcaaacaagagtacctattttttttggaatcggtccagctaaattgttgttagataaatctatgctcattagaaatattgtattttttgtatagttaagttcctgcccttttgtcactacagttaaactgtcatcagatggtcccatggtaaaataatcatactctccatgatattcttcatcg

SEQ ID NO: 142 - DNA, 229 bp, Saccharum
ctgtctggtcgatttagtactgttattgccaacacagtttagttgctcacgcaataacagcaataacgtgaacaactaaactgtgttggcaatgtctgtctggtcgatttagtactgttattttcgttggttaaaacaaggttgctattgagactcgtttctgttattttatatcgaacatcgggtgtgagccatgcatggttatgagttttgttactacccttgttgc

SEQ ID NO: 143 - DNA, 2351 bp, Saccharum
aaacaaggacgatgcaaacatatgggcattcaaatataggaagtgatgatatatacaggggaaacagtatactaatatttttagactatgtacaatctgaacaaggatagctctagtcgtgttcgatccatctctcctaggacacaatttgtatggggaaaaaggataactgtgtccagctttgatcgtgccctattactttgcacatctaatacgtgacagcaacacgaagcaggtcaaaacttatttacattacagtccaacagttcccatcaagacaatacgctatatagcatacttgttttcgacggaaggcaagtgatagccggtttactccaggattaaaaaaaaaatcattaaacatgctttggaatctccatgacataaattcttccatgaagtaagcacttgataaataatcacttggagtagggtaaacgagaagatgacccctttatggcttccgaacctttacttcacattcattgcagcggccattttcctcaacctttgagatatatcagtgaaggacggtctctcagctggatcactggaccaacaactttccatcaaccccttccactcaggatcacaccacgaagggatttgaggacgtagggaatcgtttacaatgcccccaataatttcagcagcacgcatatcagagtatggctcttccccagtaagcagctcccacatgacaattccaaacgaatagacgtcgatcttctctgacaccatattacttttcccactcagaagctctggtgccatccatggtaaggttcctctaacaccaccagataccaaagtatgctgtttaacctttgatagtccgagatcaccgatcttgcagattggtcgctgcggatccctcatgttcaccagtagattctcacacttcaggtcaaaatggactatattcttcccgtgcaaatactccatgccaaatgcagcatccatggctaatattactctcttcctgcgatctattgtcctgtcttttttcctcaggaactgtttgagagacccattgaccataaactcagtaacagttgctaagcttccatccggaccatcacgaactacaccataaaatgaaaccacatttggatgatgaagtgagcttaggatcagagcttctttccagaaatccgcaatcaaacgctctctctcagatggtcttccagcaaagcaacttgcttttattcttttaatagcaacatcacatcccctccatttaccatgatagactgccccataagtacctgaacccagctctctaatttcctccaaatcatcattttgtatagtctgtagtccttttgacaaagcttcagcttcagcagttgtagactcaatcttggagctcttctgccgatcaaggcttccttgcaaatcagagtcctgatttgcatcggtattaccagcagttgcctcatccaacttctttccattatcgtcatcatcaggaacaggtgaaacagcagcattagcatctgattgggctatttgtgtctcagcagcatcttccagtgctgcctttttaacagaggcaattaattcgggaaggaaattcaacctatcctctgaaatatccccacattcctgcagtgctgcagccccagcttcatgttgcttttgcctgctttcatgttcggctggctcctcctgcttaggatcgacttcatgtacagctccaacatggtggggtaaggtacttggttcattcacagcatgcaaaggaattgtttcattcatatttcgagtagagttaacatcatctggaccttcaagtttcttcatcgtgtttgcatccaacctggataattgatcagtgaggggcaatgcagaaacagctactttgctatcagccggcatgggttcagggtatgctctttcaggatgaacctccctcaatggagctccaggttgatgctggattgattcaggggcaataaaaggctgaacatactgagcagcagttggattagacctaggaccaaaagcactagtgttttccatggcagcaggaacatcatgcccaacaactctatatggtatgttgccattgggaggagtccatgggtttggcattagatcatatccaggtagacctggtatcctaggactgacatcacctgtatttctaacaaagttcgtgttaatgctcccatttggtattggcaggtgtggggaatcatatggtgaggcagtgtgaacagggctgttcgctctcctcctcagagactgaatgggtggcaaattctgctgcatttggtaaaaggaatctgcaccataggccgaagagtgattgtaatgctgaccaggggattcttcaaaccctgctg

SEQ ID NO: 144 - DNA, 939 bp, Saccharum
ccggccgtccgtccgatccatctcccaagaaccagtaatccgtatcagcgcagaccgagccgctccgacggccatggcggctgcccgcctctccctggccctcctgctggtcgtcctggccgtcgccggcgggcgcgcggcggcgcaggactacgacttcttctacctggtgctgcagtggccagggagctactgcgacaccaaacagagctgctgctaccccaagtccggcaagccggcggcggacttcgggatccacggcctctggcccaaccgcgacgacggctcctacccgcagaactgcagccccgacaacgccttcaacccgtcaaaggtgagcgacctgctgagaagcctgcgcgccaagtggccgacgctggcgtgcccttccggcgacgggctcaaattctggggccacgagtgggagaagcacggcacctgcgccgccaacgtcttcgacgagcacggctacttccaggccgcgctgcgcctccgcgaccagctcggcgtcctcgccgcgctcacctccgccggcgtcaacccggacggcggatactacacgctgagccagatcaaggacgccatcagccagggcaccggcttcgagccctacgtggagtgcaaccgcgacgaggccggcaacagccagctctaccagctctacttctgcgtcgacgccgccggcgacagcttcgtcgagtgccccgtcctccccaacggcaggccctgcggcaacaggatcgagttcccggcgttctaagctagtactaactgttctcgtcagttgttccaattctctgcaagaggataacggaatgttcgttccccattcttcaaagttatttttttctttttgcaaataaaaggagccggtagatgtactatatttctgttgaagaaatatgcagtcggtattattatttgtcatcacattcagag

SEQ ID NO: 145 - DNA, 692 bp, Saccharum
cagctagccctcctgcctccgatcatccatccatccacagcgcgagctcgctcgcagtcgcagctagctagctctctcgctccgacgatccggccggcgaccgacgcatacgtccggcgagagctgctagtgctgctgctgtatcggagccgatccacctgccgtgtctctgctacaacgtagagaggaagagcggacgaccatggccggcgcgactgtgaccgtggaggaggtgaggaaggcccagcgcgccgccgggccggccaccgtgctggcgatcgggacggcgacgcccgccaactgcgtgtaccaggcggactacccggactactacttccggatcaccaagagcgagcacatgaccgacctcaaggagaagttcaagaggatgtgcgacaagtcgcagatccggaagcggtacatgcacctgacggaggagtacctggcggagaaccccaacatgtgcgcgtacatggcgccgtcgctggacgcccgccaggacatcgtggtggtggaggtccccaagctgggcaaggccgcggcgcacaaggcgatcaaggagtgggggcagccgaaatccaagatcacccacctcgtcttttgcaccacctccggcgtcgacatgccgggcgccgactaccagctaaccaagatgctgggcctgcgcccctcggtgaaccgcctgatgatgt

SEQ ID NO: 146 - DNA, 940 bp, Saccharum
ctctttctctctcttcttcctccgtcccctcgactctccctctcccacccccaccaagcagcgccggtcaccatctctccccatcccctttgccgcccttggtcttctccctcctcagggcagggaggggaagcggaagaaggaggcgagagcacggaagcctgatttgatttgcttttggttgccgagaggagggagttggtgcagtttgtaggcgtgcctctgtgtctctgtgtgtggagatggaccccaagttccccacacccccaccgctaaacaaaacggagcccaccaccgcgacgaccaccaccaccacctcgaccgcgcagcagctggatcctaaggactaccagcagcagcagccggcgcagcaccacctgcaaatccaaatccaccagccgccgcagcaggacgggggcggcggagggaaggagcaacagcagcagctgcaggtggtggcgcagcccggggagcggaggcagcagccgctcgcgcccaagcggagctccaacaaggaccgccacaccaaggtcgatggcaggggccgccggatccggatgcccgcgctgtgcgccgcgcggatcttccagctcacgcgggagctcggccacaagtccgacggcgagaccgtgcagtggctgctgcagcaggccgagccggccatcgtcgccgccaccggcacgggcaccataccggcgtccgcgctcgcatccgtcgcgccctcgctcccgtcgcccacctccgggctcgccaggccgcaccaccaccaccatccgcaccacatgtgggcgccttccgccgcgtccgcgggtttctcctcgccctccttcctcaattccgccgccgcaggcacgggagacgccgctggtatcggcggcatcatgcagcggatggggatccccgcgggcctcgagctgccgggagggggcgccgctggggc

SEQ ID NO: 147 - DNA, 2018 bp, Saccharum
  misc_feature 961, 964: n = A,T,C or G
tagatctgtgctgtgcgtgacgacccagctctctatctatccccgtccctgtctcgccatcctcctttctcctcctcctcctctactccccaccgagcagagcgaatccttagcgggcaagtctttccgagctcgcggagtggggtttaaaacgcggcccgagaaaaggaggaccgcactcgctgctgctggtcgcttgctttcggtggcgagcgtctcggtaaagcggcgtcggcgtcggaggcggcggcagagactggacttgcttgctgcccagtgcagtgctgccttggagacaggatcctgctgcagggactcataattgatcagtgtgtccaaagaccagagaggaacgtgactgagtttgccaccttcatccactgtggtcgctcgtctgctaatgcccgcattggaggattgctcacggatatgcttctggtgatgggtaacccggggcgctcgcggctgctatcatcgctgattgcttccgccgccatcttgctgttactctctgcgttgccgatttgtcggccctacacctacgagcaagatgtgtttgccataaatggcttgtacacggcacttggagcaccacagctgcctaattggacttcaaatggtggtgatccctgcaatgagagctggcagggtgtttcatgtgtagcgtcaaatatcacctccatagttctcagcggtgcaaatttgggtggacagctgggcaacactttggggaatttcacatcattaatcaccttggatctcagcaacaataatatcggcgggaccataccagatggtctaccactcacaatgcagagatttttcctttcagctaaccagctaagtggtagccttccaagtacattgtcgtcccttacacttttgacaagcatgtcactcaatagcaatcatttgactggagcgataccagatgtattttcagcactcactggacttgcanatntagatttttctgacaacaacctgaccggtccgttgccaccttcaatgggaaatttgacagcattgactagcctacatattcagaacaatcaaatatctggaacccttaatgtgttgcaagatctccctttccaagatttgaacattgaaaacaatcttttctctggtcctgtgcctgtgaaattactgaacttgccaaacttcaagaaggatgggaacccattcaataccagcatagctccatctgcgcagccacccttggcgccaacaccattaccatcagtcccaccttcaacagggcatgtcccctcaaaagaacctgcacattcttctaatgttccaggtggaagtacttcaggatcaggaaaacatactacactcaaattagttggatatattcttattggggtggtattagcagtagttcttgtgctaattgcaatgtactgtttatccaagtacaaagaaaaaaagtcgagaggtgatatttatctgaaaaacaagataggaagggtacctcagaagcttggagagcctaaaatcaaggaagtggtagaaatgaaggagtcaccattaaaactcaagaataatgctgagaaaggcttcgaatgttgtttctgatggaagagaggagcagaagttaaaaatgccaacgtcagaaacttcaaatgtggtttatgatccaagttgaagggatgggcagaacttagattcgtcgatggcagctgtacctggggttgttacaatgaatacaaaagagcatgtgattgatatggaaaaggctgataattttgttgaggaccaactgcaccccccgcagccgattgcaccgcggactgaaaaagtcattgtcaaaccaagtgttcgtacaagaaagggaagagtaccttcagttgaaaaggtggaatcgacgactactgtcaagtccttctccattgcatccctccaacaatataccaatagtttcagtgaggaaaatatcataagagacagcaggtttggtaaggtatatctggcaaagctttctgattgaaagctactggaaattttgaaga

SEQ ID NO: 148 - DNA, 1022 bp, Saccharum
ccgtcctactcgccgccgccgcggggctcgtccacggaaccacgcaccccgcggaccaggcggcgctggacgacctccggaaatccctaacgaacccggacgcgctggggtggccggacaacggggacgcgtgcggcccgcccgcgtggccgcacgtctcctgcgaccgctccggccgcgtcgacaacctcgacctcaagaacgccggcctggccggcacgctcccgccctcgctctcctcgctcgccgcgctgcgcggcctcagcctgcaggggaaccgcctcacgggcgcgctcccgtcgctccgcgggatgtccgcgctccagcacgccttcctcaacgacaacgacttcgatggcatcccgggggacttcttcgacggcgggctcaccgacctgctcgagatctcgctcagcaacaaccagcgcctcaacgcgtccaccggcgggtgggcgctcccgccgggactcgccgcctccgcgccgcagctgcaggtgctgtccctcgacaactgcagcctcagcggcgggatcccggacttcctcggccgcctcacggggctccagaacctcatgctctcctacaacaacctctccggccccgtccccgccgcgctcaacggctccggaatccagaggctctggctcaacaaccagcaaggggaggccaagctgtccggcaccctcgacgtcgtggtcaccatgacgggactccaggagctctggctccacggcaacgacttctccgggcccatccccgacgccatcgccgactgcaaggagctctacaccgtcaggctcaacaacaacctgctcctcggcctccttccgcctggcctcgccgcgctccccgcgctccgggagctcaagctcgacaacaacaacctcctgggccccgtcccggcgctcaaggcccccaatttcaccttctccgggaacgagttctgcgccgccatccccggggacgcctgcgccccggcggtcatggaattgctccacttcctcgccgacgtgcagtactcg

SEQ ID NO: 149 - DNA, 510 bp, Saccharum
gagataaaccaaacgacgaactattgcattgatcaaaccaaaacgacagcttcactaaccagtaaaaacactgaccaaaatagcaatgccacaaccattgcaaccctgaacagcacaaacagattgtataggctacttcgaaactatcctcagtgctatatcgtgcaatacaaacagtttccataaacgtcacacaaaaacaggtaggcagctcatcggatacaacaagcaacccgagcaagcccgaattgggtgcacaccaatcaacgcatcagcaatgccgcctactagtactagactatcatccagcatagccgtccatacatttccaggcttcagtcagtactcggacgttgagatgacatcgtcaatcttgaggatcatcttcaccacctgagtggcaagcaagatctgttgctgcttgccgatcagggtctcaaagacgttctgctctttcatgtcattggtgccaacatcgttgcagtctatgccatagtgagggttgctctc

SEQ ID NO: 150 - DNA, 542 bp, Saccharum
gtcgaggaggacgttctgaggcttgacgtcgcggtgcgcgacgccgcgcgcgtggcagtaggagagcgcggcgacgagctgcacgaagatgcggcgcgcggtgtgctccgtgaggcggcgccgcgggagcgcggcgagcctagacagcaggtccccgcccggcgcgagctccataacgaggtagatcctggcgcgcgtggcgagcacctcgtggaggcggagcacgttggggtggtgcagccggcgcatggccgtcacctcgcggagcacgcgcggagccatgcccaccgtgcccatgacctcggccttgtcgagcacctttacagccacagcctcgccgccggccaccgggcgcgcgaggtagaccttggcgaacgtgcctcgtcccagcaagctacccagctcgtacttgccgagcaggctcttgctcttcttgctcccattactcttgctgtccatggcccccatgggcgacagcaacagcgaggcaagagcaccacaaggttggcgctcgtcttagtgttatggcaatgagttcggcg

SEQ ID NO: 151 - DNA, 707 bp, Saccharum
tataaagaaaatttcatttgaacatgagaataaaaacaaagtacaataacaaaattttgtttgataatttctatcagcgttacacttgtcacaatatctaaagttgatgattctacttctcatcaaattattcacctagccaagcccacacaatgtatttcagtgcgggtctcatactttggttcataaaattttgatactcaaggctatcaccgttggttttcttaatctccactagatgaaaatttggtgtgatttgaaatatctcagcatttatggacatcacgccttttattcttggttgggaaacttccatctgcaacaatccactatttttctttataaccttcagtcctaaactctttgcaacttccatgagctttgtgacaattgttgaagttgtgttggtagatgtaaatttagactcctccttgtttgagttattctcaaaaatacctgagagatcaagcccattggaaagagagatgatatcaaaagcattcaaattagtaagtttctctgttgctgagttacactgaactgtattgctattcaaagaatccaaagtcaaatccacatcaataggcatatcatctcttcttgtattcatagtagaatcaaacaatcttgcctcaagaccaattataaaccaaggatgtttcattatttcttcaatagagattcgtctattagggtttggatgaagg

SEQ ID NO: 152 - DNA, 561 bp, Saccharum
caactagctgcagacctagttatcaactagtttgctagctaggcctgaggatattgatacaacaggagttgctgcagccgccgattgcactcgcactggtacttaccaaccctgcgcgtggggtgacttctttgtgacttacacccttcctccctcgcagaggtccgaagagtggatgagagagagggcatatgagctcaaggggaaagtgcgtcagatgtttgtgggcggcacaaccatgagcacagctgacatgttgcgtttggtggacacccttgaacgccttggcatagacaagcatttccatgaggagatcgccgtggcgctaagccgtatccacactagtagtgaagagcaggacagctccaacgatctgcatggttgtcgcgctcaagttctgtctgcttagaacacatggcttctgggtatcaacagatgttgttgaacaattcagagatggcacgggcaatttcagaaaggatttggcaacgatcccattggactgcttagcctatacaacgcagctcacatggcggtcccgggtgaaggaaccctagatta

SEQ ID NO: 153 - DNA, 374 bp, Saccharum
aaaaaaaaaaaaaaaaaaaaaaaaaaggggggggggggaatctcgataatccattcatgcgcgtcactaattaaatgacgaggcatttggctaccttaagagagtcatagttactcccgccgtttacccgcgcttggttgaatttcttcactttgacattcagagcactgggcagaaatcacattgcgtcagcatccgtggggaccatcgcaatgctttgttttaattaaacagtcggattccccttgtccgtaccagttctgagtcggttgttcgacgcccggggaaggcccccgaggagaccgttcccggtccgtcccccggccggcacgcggcggcccgctctcgccgcgggagcagctcgagcagtccgc

SEQ ID NO: 154 - DNA, 760 bp, Saccharum
atacacaaataaagccactcgcatgtactgtatatacttttatgaagaaaaacgatgtagcatgcacaacataaacagtacacagaccaaattacacacgtacaaactcacaccacacaaaaagtggaaattgtccctgtctcacgagcggtcgtcattaaggatagggacacttattcatggccgggttcatcttattatctacggaacaccgtgacagtaattaagtacggctttcacacgccggacgattagtgctgtccgggcagcttctccttgatcttgtccatgatgcctttcttctcgccggtgccctcggtaccgtaggttccgccggtgtgtccctgctgcccgtaggcgccgccggtcgccgtggcgtgctggttgtccttgtggcctccgggcagcttctccttgattcccttcttcctccttccgcccatgccgtcgtcctcagacgagctggagctggagctgccggagcgatgcaggatgccgccggtcttgtgctcctccctcgctggctggaactgcccgccacccatgccagcgccgccgtgctggcccatgccgccggttccggtggtgccgtgctcgacgccgccaactggattgccgtactggtcgacacggcccgtggtgccgtagccgtgctgcccctgctgaccgtactccatgtcgtgcggcttggtggtttctctcagcaagattctccctaagctaagctagagctctgcgtgctcgtggtgttttcgctgtg

SEQ ID NO: 155 - DNA, 467 bp, Saccharum
gtgcactcacttctgcatcccagctctgtgaggtgaggtacatatttatatagctacgttttgtgcagtttcaaggcatacaaaccctgttgtcaaaaaaaaaggcatacaaacccgagcagtatgggcatggctccagctcgagttcttagattcgtgtcggtcgcagtcgcctgcttgctggccatggccgccgctggtgaggccgccaccagcggcactcggacgccgaccggatggctgaaggcgcatgccacgttctacggcggcgccgatgcctctgacaccatgggaggggcgtgcgggtacggcaacctctactcacagggctacggcacgcggacggcggcgctgagcacggcgctcttcaacgacggcgcatcatgcgggcagtgctacaagatcgcgtgcgaccgcaacagagctgaaccgaggttctgcaagcccggcgtcacggtgaccgtcac

SEQ ID NO: 156 - DNA, 671 bp, Saccharum
  misc_feature 125: n = A,T,C or G
gcgcatgctggtcacccaatacatgcccaacggctccctctacgaccgcttgcatggccacgggcaccagtcgtgcatcggcgcggcgtgcgccatcgagcacctgcactgccacgccgtgccgntcatcatccacggcaacgttgcctcctccaacgtgttcccggccgccgccaggacgccgcacctgtctggctttggcgcgtccgtatggcgggcggcaagcgtggcgtcacaggccgtggaggtcgccggcgccaggtcgtgcaacgggtacgcagacccggagtactttatcacgggccgcatcaagccggccagcgatgtttacggcctcggtgtggtgatgcttgaggtcctgacggcgcaactaccggtggtgagtgtctgggacgaggcgaagaagagcgtggtgcccatgtccttggtgtcgttcgcgctgccgagcattcaggccggtaggctcggtgacgtgctcgtgctcgaaaggcgtccggcggcgcatccgacgacgtgccagcaactccagccggtgcaagttgtggccacaatggaggcccattgtctgtgcctgcaatggggacaaccccccccgccatataaaaacatcgtagcgcgcccaaccttgagcaaggccttccgcctaatattgaaaacatgtatgccatgga

SEQ ID NO: 157 - DNA, 721 bp, Saccharum
cagcatcctatttaaatcccttgttgtcgctcgttccagccagaacacaagcagcagctccagctacttgcatcagctaattaagcaagcaaggcctaggcaacgagccaacaagcaccagtcatggcctccaccaacagctggaccctcgagatcgcatcgccggtggccgcgccgcgcctgttccgcgccgccgtgttggactggcacacactggcgcccaagctggcctcccacgttgtcgcgagcgcccaccccgtggagggcgacggcggcgttggcagcgtcaggcagttcaacttcacctcagtcatgccgttcaccttcacgaaggagaggctcgatttcctggacctggacaagtgcgagtgcaagcaaacgctcatcgagggcggcggcatcggcgttggcgtcgagacggcgacgtcgcacatcaaggtggagcccgcggccggcggcggcagcgtggcgaaggtggagacgacgttcaagccgctgccgggcgtggaggtgaaggacgagatcaccaaggccaaggagtcgctcaccgccattttcaagggtgccgaggcctacctcgtcgccaaccccgacgcctacaactaaatcggtggattgggtcattgggatgcgattccccttcctgaagtttgggtttaattttcgttttctttcctggagtttctcttttttttcatacaaaacaaaataaagctgctct

SEQ ID NO: 158 - DNA, 526 bp, Saccharum
  misc_feature 415: n = A,T,C or G
cgtgaacgtggtgaagctgctgtgcagcatcacgagctcggacggcgcggcgagcctgctggtgtacgagcacctcccgaacggcagcctgtacgagcggctgcacggggcggcggcggggacggggcggaagctgggcggcgggctcgggtgggcggagcggcacgacgtggcggtgggcgcggcgagggggctggagtacctccaccacggctgcgaccgccccatcctccaccgcgacgtcaagtccagcaacatcctcctggacgagtcattcaagccgcggctcgccgacttcgggctcgccaagatcctcagctcgtccggcggtgccggtgactcgtccgccggcgtggtcgccgggacgctggggtacatggcgccggagtacgcatacacgtggaaggtgacgganaagagtgacgtgtacagcttcggcgtggtgcttatggagctggtgacagagcggcccgccgtgctgcgggcggagggaggccatagccagcaccctgtggactgggtgttg

SEQ ID NO: 159 - DNA, 1105 bp, Saccharum
cgcagctttcccgcttctcctggtcggagccgcgatggcttcagctgtgtatgatgagaaggactcggggggcagagctttcttgctcctccgtgacctgtaccccggttccaagatgacgctccacttcgccggcgccgccagagcacccttgctcccacgcgcccgcgcggaatccatcccgttcacctccaccaaaatcccggaaatcctgtcccgcttctccatcccggccggctcccccgccgccgccgccatacgctccaccctgaaagagtgcgaggccccgccgctgaaaggcgtggtggcccagcgctgcgccacctccttcgagtccatggccgacttcgccgcctcttgcctcggcacccgagacgtccgcgctgcgacgatgaccaagctcagcaaggacggggcgaccccgaggcaagtgtacgtggtggagtctgtcaggcccatgccggtgtccgacgggtacatggtggcctgccaccgcatgccctacccctacgccgttttcgcgtgccacacgaccaccgccaccttgtacgcggtgaccctagccggcgccgacgggaccaaggccgatgctgtgacggcgtgccacaaggacgcgtcgcccggcattttctcgccgacgtacaaaaagctcggggtggcgccggggagcgtgccggtatgccacttcctgcccccagagaacacatgtttggaaggcgcaattaaaaggcttcgaatcacaagtacctgcagagaaaccacaaagtgccggtcacgtatatacgtacgtgcttttgttcacctattctctgtaggctattactcgatcgctcatatgtatacggtatatcttgtgcttttgtgtacgtacgtaatgtgttgtatgtatgcatgttggtcgtgttatatgaacctgtactcgcgagccagatacggctgcctccgcccctgggaatatgcgcatatggtacatgcttttgcaaaatataaaggaagctattagagcatcttaatattttgttcatcaaaatatggtgtttgtcaacttctaaattcagtatggggagaaaacaaagaagtcatctccaagggtctccaaaaaaaa

SEQ ID NO: 160 - DNA, 1493 bp, Saccharum
aatagaatagaatagaacgttcctccctccctgcctcgccccaccaaaccaaaacccgcccggttctcagggtccatcgtccactactgatccgctccacgcgagctcctcttgtccccggctccccgcctccgcgtcgcgctcgcgcccgagcaagtgctagcaggcttagcagcaaagcaagcctcccctgatggctctggtgccctcaggctcgggtgccggccaggtgatcgccgaggtggcgatgaacggcggcgccgacccgaacgcgaccaccgtgcgcgctaccgtcgtgcaggcgtccaccatcttccacgacacgcccgccactctcgataaagcagagagattgatagcagaggctgctgggtatggttcacagttggttgtctttccggaagcttttattggaggctatcctcgtggatccacatttggcttcgggatcagtattagtattattaacccaaaagacaagggaaaggaagcattccggaggtatcatgcagctgctatagatgtgcctggtccagaggttacacgcttggctgctatggctggaaaatataaggttttcttggtcatgggggtgattgaaagggaaggttataccctttattgttcggtgcttttctttgatcctcttggccattacctgggtaagcaccgcaagctcatgcctacagcattagagagaattatatggggatttggggatggatcaactattcctgtttatgatactccacttggaaagattggggcgctcatttgctgggaaaataaaatgccacttttgaggacagcgctgtatggtaaaggtattgagatatactgtgcccccactgctgactccaggcctgtttggcaagcctccatgacacacattgctttggaggggggatgctttgtcttgtcagcaaaccaattctgccgcagaaaggactacccccctccaccggagtatgagtttgctggtttaggtgaagagccatctgcagacactgttgtttgccctggaggaagcgttatcatttctccatctggagaagtcttggcaggtccgaactatgagggagaggcactgattacagccgaccttgacttgggagagattgttcgagccaagtttgattttgacgtggtgggccactattctcgacctgaagtccttagcttggtagtgaatgaccaaccacatttccctgtatctttcacgtctgccgccgagaagactccagctgccaagagtgacagcgatgctaagtcttactgattgagtgtggccatgaaactattatgttgtaccgaagccttggtgaaggtcgctcagctcctctggtttgctgtttgtgtgtcgtggatgggagttgggagttgtagcttttgaactctaaaaattctctttaatgatgcagaaaaaatggtggatgcagttatgttccttgtaaagtcttgtgttcggtgaataaactctgccagaactatga

SEQ ID NO: 161 - DNA, 1713 bp, Saccharum
ctttttcttagtgccatgcatctttcatgctacattttccttcccaaaattaaaattcgaaattgaggtgagaaaaaggaaagcagttggtaaatgcgtgttttggtgcggtggttggtgagctctccggccccatataaccccctcccacctcctccttcctcttcgcagcagcagcgcacgccaacacttcccaagctcgcgtcgctcagctcctcaagcccaccagaaaaggtctctctccttgtatcctcctctccaccgggcaccggccggccgtcgtcaggcatgggctcgaccgccgaggacgtggccgcggtggcggacgaggaggcgtgcatgtacgcgatgcagctggcgtcggcgtccatcctgcccatgacgctgaagaacgcgctggagctgggcctgctggaggtgctgcaggcggaggcgcccgcggggaaggcgctggcgcccgaggaggtggtggcgcggctgcccgtggcgcccaccaaccccgacgcggcggacatggtggaccgcatgctccgcctcctcgcctcctacgacgtcgtcaagtgccagatggaggacaaggacggcaagtacgagcggcggtactccgccgcccccgtcggcaagtggctcacccccaacgaggacggcgtctccatggccgcgctcacgctcatgaaccaggacaaggtcctcatggagagctggtactacctcaaggacgcggtgcttgacggcggcatcccgttcaacaaggcgtacgggatgacggcgttcgagtaccacggcacggacccgcgcttcaaccgcgtgttcaacgagggcatgaagaaccactcggtcatcatcaccaagaagctcctcgagttctacacgggcttcgagggcgtctccacgctcgtcgacgtgggcggcggcatcggcgccaccctgcacgccatcacctcgcaccacccgcagatcaagggcatcaacttcgacctcccccacgtgatctccgaggcgccgccgttccccggcgtgcagcacgtcggcggggacatgttcaagtcggtgccggcgggcgacgccatcctcatgaagtggatcctccacgactggagcgacgcgcactgcgccacgctgctcaagaactgctacgacgcgctgccggagaacggcaaggtgatcgtcgtcgagtgcgtgctgccggtgaacaccgaggccgtcccgaaggcgcagggcgtgttccacgtcgacatgatcatgctcgcgcataaccccggcggcagggagcggtacgagcgggagttccacgacctcgccaagggcgccgggttctccgggttcaaggccacctacatctacgccaacgcctgggccatcgagttcatcaagtaaatacgcacacctgctgctgcctgcgtcgagctgcgatggcacatggtggtcctcgtacatcgccgtcgtcttcttcttcaagttgcgttgctgctggtgctctcgcgcatgcatgatgtactctttttgcttatattttgctttcttcattctgcagtctggcctagcctgcctctatggcggtggcggccatatcttcggtatgtcttgtcgagctcttgcgtgttctggattctaaattgtcgaattgtctctgccatgtaccagtaataacaatcaatgatatacttactatacaaatgacatgcgtgatggtttctccgttttcgtgaatcg

SEQ ID NO: 162 - DNA, 1247 bp, Saccharum
cctcaccttcctccaccttcccctcctctgcccccaccgcccgcttccttctgccttgctccattgcttcttcccaccacagtccactccactcgccggccctgcagctctgctcagtatttgactgattggtggtggagccgctagcagctcgactcgcctgctacttcttggtcctgacggtgcgttcagaccagtgccgactacgagctgtgaggagagggctaggaagcaagcctgccagggaggtggcgatggagaggtacgaggtgatcaaggacataggatcgggcaactttggggtggccaagctggtccgggacgtcaggaccaaggagctcttcgccgtcaagttcatcgagcgggggatgaagatagatgagaatgtccaaagagagatcatgaaccacaggtcgctgaggcatccaaacatagttaaatttaaggaggttgtgctaactcccacacatttggccatagttatggaatatgctgctggtggtgagctatttgaaaggatctgcaaagctggaagatttagtgaggatgaggcaagattcttcttccaacaactgatttcaggagttagctattgtcattcaatgcaaatatgtcatagagatttgaaactagaaaacactctcctggatggtagtatagcacctcggctaaagatatgtgattttggttactccaagtcctctgtgttgcactctcaaccaaaatcaactgtcgggacaccggcatacattgctccagaggtccttgctagaaaggagtatgatggaaaggttgccgatgtttggtcatgtggagttactctgtatgtgatgcttgttggtgcttatccctttgaggaccccgacgaaccgaggaatttccgcaagacgcttactcggattctcagcgtccaatacgcggttcctgattttgtccgagtttcaatggagtgcagacatctgctgtctcggatctttgtggcgaaccctgagcaacggataaccatcccagagatcaagaaccacccgtggttcttgaagaacctgcccattgagatgaccgacgagtaccagatgaacctacagctggtcgacatgaatgacccctcgcaaggtctggacgagatcatggccatcatacaggaggcccggaagcccggcgatgggctgaagcattcgggacagcctcccggactggggagcatggagctggatgacattgatgtcgatgacataaacgttgaggac

SEQ ID NO: 163 - DNA, 787 bp, Saccharum
cccgctcgcgctcggcgctccgcaccgcagcgaccgatacaatacaacacgacccggggcttgagatcgggagcttccatcgtgcgtcgcggggatggcggtccgcagtgggtcttcgtacgccgccgcggcacttctcgcgctcgcctctgtcgccgccgtcgccggcgaggtcttcttccaggagaagttcgaagatggctgggaaagtcggtgggtaaagtccgagtggaagaaggacgagaacatggctggtgaatggaaccacacctctgggaaatggaatggagatgccgaggacaaaggtattcaaacctctgaggactacaggttctatgccatttcagctgagtaccctgagttcagcaacaaggataagaccctggtgctgcagttctctgtgaagcatgagcagaagcttgactgcggtggcggttacgtcaagttgctgggtggtgatgtagaccagaagaaattcggtggggacacaccttacagcattatgtttggaccagatatctgtgggtacagcaccaagaaggttcacactatcctgaccaaggatggcaagaaccacttgatcaagaaggatgtgccttgtgagactgatcagttgactcatgtttacactttgatcatccgtcctgatgcaacatacagcattctcattgataatgaagagaagcaaactggcagcatctacgagcactgggatattcttccccctaagcaaatcaaggacccagaggctaagaagcctgaagactgggatgacaaggagttcatt

SEQ ID NO: 164 - DNA, 437 bp, Saccharum
gcaacaaaccgatcgaaggagggttcttattatattggcgtagaatccaggaaaaggtgaggccactacaacaaaggtaggcacgctagatccctcgaagaaataaagaaaggtaggcacgctagatccatcagacacgtcgtcgctagcgactagcagtagcagctgctgatgaattcatgatgacttaagctgatctcattggctaaaaggactgctggctgatttttttaaagaaaaacactgttgactgctgactgatttggctaataattggctgataatcccaagcgaacagggtgacgatgagggcgtccacacatcacacgtcgcgggagccctcgggcgtacgttgttctgtttgttcagacttcagaggaagcggttgaggtactcatggacggtggtgtacttgacctccgggtacagctcggcta

SEQ ID NO: 165 - DNA, 317 bp, Saccharum
cgctgccatggcctgcctcaccctcgtcgccaacggccagtgccgccttcgctcatcggtctctgcttcaactgtctggcaacagaccacatcgccgcccggtgcaccttcccgtcccgctgcctcatctgccttagcaggaatcaccgggcaagggactgtaggcttcgtcgtccgccccgacacctctcctcggaccgtgtgcgggagcctccaagacgtggtcttcggcatcgtgccgatagaggccaccacggtcgcgctggctcgctctcgcaccaaccacgtcccgaggctgccggcgttgatgatgacag

SEQ ID NO: 166 - DNA, 680 bp, Saccharum
gttttgtggaggggagatggcggcggcggacgtggagtaccgttgcttcgtcggcgggctggcctgggccaccaacaacgagtccctggagcacgccttcgccacctacggcgagatcctcgactccaaggtcatcaccgaccgggagacggggaggtcccgcgggttcggcttcgtcaccttctcctccgagcagtccatgctcgacgccattgagaacatgaacggcaaggagctcgacggccgccgaacctgcgcgtggccgctgtggcggcggcactcttcctcgcgcccttctcgtacctcgcgttcgtgcactaccctctgggcgccgatctgcagcgatccatcctcaaatgcggcgccatgagcctcgttggcttctgcgtcgcgctcaagctcatccctgtcgcggcccgctaccacctccgccgccggatgttcggctacgacatcaacaagaaaggcttgcccacgggccaaatcaaagtgcctgaggcactaggtcttgttgtggggattgtctacttggtcattgctattatatttcagcagtttcactatgcccaagactccatttggcttgttgaatataatgcagcgttgacatcagtctgctttatgattcttcttggatttggtgatgatgttcttgatgttccatggagagtgaaactggc

SEQ ID NO: 167 - DNA, 2068 bp, Saccharum
atatggcagatcagattcatcctgtctggggctgtgttgacaactatgcaactgcaagggaaaagcgtaaacagttacttcaaacgctttctcagaatgaggcagacagacttgaagtctgggcacatccaataaatacaaaagatacgacgacttttcgtggtaaaatgagctcggataaatggattgatcatgtcagaactgcttttgctgttgatcctcgaattgctctttctatgcctttgaggtttcccacaaatgcaacaatgcaatctgagattactcagctggtacagacacgactactagagcttcgtacaattcctgaagcattaccttttttcattactccaaaggcagtggatgaaaattcagtgttgttacagcaactaccacactgggctccatgttctgttacacaggcattggagtttcttactcctccttataaaggacatccacgtgttatggcctatgtccttcgtgtcttggagacttacccccctgagactgttaccttttttatgccacagttggtacaatctctcagatatgatgaagggaaactggttgaagggtacttgcttggagctactcgaagaagtaatatatttgctcatatcttaatatggcatctgcagggagaatacgttgatgaatctgagaaagatgcagctgctctgaagggcagtgctttccaatccttgcttcctgctgttaaggacaaaattatagagagtttcactccagaggctcgtgacatgtttgaaagggaatttgatttctttgacaaagtgacctctatttctggtgttcttttccctcttcccaaggacgagcggagagcgggtataagaagggaactggagaagatttcgattccaggtgatgacctctacctacctactgcaacaaacaagttagtacggggtatacagttggacagtggtattcctctccagtctgctgcaaaagttccaataatgattacttttaacgttgttgaccgtgacggggacccaaatgatgtaaaaccacaggcttgtatttttaaggttggtgatgactgtagacaagatgtgctggcgctgcaagtgattgctctattaagggatgtatttcaagctgtcggattaaacctgtatctttttccgtatggtgttttgcctactggaccaggccgaggcataattgaggtggtcccagatactcggagtagaaatcaaatgggtgaaacaactgatggtggtttattagagatatttcagcaagattatggtcctgtaggttcaccttcttttgaaactgctcgagaaatgtttatgatcagtagtgctggatatgctgttgctagcttactccttcaaccgaaggatcggcataatggcaatcttctctttgatagccatgggagattagttcatattgattttggttttattttggagatttcacctggaggtaacatgggatttgagagtgcacatttcaagctaagccacgagatgactcaattgctggatccatctggaactatgaagagtgatacatggaaccaatttctcagattgtgtgtcaaaggatacctagcagcaaggaggcatatgaatgggattttaagtacagtcaacctgatggttgacagtggccttccttgctttagcaggggagatcctatcaataatcttcggaggcggtttcatccagagatgaatgaacgtgaggctgctaacttcatggtacgaacatgtgctgatgcttacaacaaatggactaccgcagggtatgacttgattcagtacttgcagcagggtattgagaaatagtttgtttctcgttttgtaaatggtgttcgtgtacatcaattgtatgtagccactatctttttatgtagaatttattttttgagttgtgtcgttgggtaaggatggaattcacgtgattaacgtaggatgtttgttgcacagaggcaatttttttttctcgcactgtaagactgcctagaaagtagctagagtaagtagatcaagattttgtattgctgttgcagaatgtattttcttttact

SEQ ID NO: 168 - DNA, 709 bp, Saccharum
gttgtcctcgtcctttaaaacgcaaaggcgccggtggtcatcctcttttttcttttcctgctcgccgccggtcgcctctgtccgccggccaaaattcaccactgccaccgcagctcagcccaattacccgcgtcctcagctcccggtcgtctttgcgcattgcctgagctagctcgtgtcgcctttaaccaccggacttggctgcgccaccgtttctcgccgcggcagcttgccgtcgccgccgcgttcgccctcaccatggccagcgcacctctcgctctcccgtttgatgctttagcttccttgtgtcgccgtgttgctcatatgcctctctgctttatcagccgtgtgccggagccgccgtgtcatcgccgctgctgccgtgccgccgctcgcgcggccatgcctccttgggccatcacgaggcaagatgcgggtaccagcgggtgcgcacgagcctcgggatgctccccgactcttccccgacgacgacgtgcctttgctccgccgaaatcgccatcgctgatgatctcctctgctccagttcgcgtgaaggatcccgtgcaggaataagaagaaacgggagggcctaagtgtgaactctatgactcagatgaatagtgcgctatagagtttttcttttctttttctatttttagctgaaacttgtgaatttcataactatttattgatgcatgataaaatcatg

SEQ ID NO: 169 - DNA, 681 bp, Saccharum
catcactcctaatttattttatttcttattatcatatgtattgatttcgctcgccctcctttcccgactgttcccgtgcctcacaccggctcggattgcttgctctcgcttgcttgtgtcagaataagattccgcgcaagtttggattcaccgaatccaccgatctctcgcgccccgcggtcgcgcgcggtggaatttcggcctgggcggctgggcgccgccgattcgggcctctccggaagggtgaccccgggtgtggttcgcctaatctccgcccaaatttcagctgccttagtgtggaactcgtcgtgattttcgactgtgcgcttggctttcctgtcctgtcctgtcctgtcctgtcctgtcccgtgttgtggcttcagcatttcaggggatggggcgccgcgggttgctcacggccgcgcttctgctgtgcttccttgctgtttgctccggcagagaacttacgatcaaacagaacccttccactaccatatacaactcgactcttgcccagatacttgtggagtatgctgctgcaatctatactgctgatttgacagaattgtttacttggacatgtgccagatgtggtgacttgatcaaggggttcgagatgatagagatcattgtagatgtggagaactgcttgcaggcatatgttggttttgccagcgatat

SEQ ID NO: 170 - DNA, 740 bp, Saccharum
aaaaaaaatgaggtaccacaagctaacatttttcagaccataacaacgttcataataacccagtagcaaagcagggaattcaacattcaagtcttacaacatcaggtgttgtagatcacacacaatcgacagatagttcaaaccaacacatagcatggtagatcacagctcacaggataatagcatctcacgggccaaaagcagcagcaccaatagtctagtactcatcaccctcgtccccttcttcaccctcgtcaaactcagcaccaacctcctcataatccttctcaagcgctgccaggtcctcacgggcctcagagaactcaccctcctccatgccctcacccacgtaccagtgcacaaaggcacgcttggcgtacatgaggtcgaacttgtgatcaatgcgtgagaacacctccaccacgctggtggagttggagatcatgcacacagcgcgctgcaccttggccaggtcaccaccaggcaccacactggggggctggtagttgatgccacacttgaacccagtcgggcaccagtccacaaactggatggtgcgctttgtcttgatggtggccacagcagcattcacatccttgggcaccacatctccacggtacatgaggcagcaagccatgtacttgccatggcgggggtcgcacttggccatcatggaagatggctcaaaggcgctgttggtgatttcagccacgggacagctgctcgtggtaagccttctc

SEQ ID NO: 171 - DNA, 933 bp, Saccharum
ctcaagcccagcaacctgctgctgaacgccaactgcgacctcaagatctgcgacttcgggctggcgcgcccctcctccgagagcgacatgatgacggagtacgtggtgacccggtggtaccgcgcgcccgagctgctgctcgacgtctggtccgttggctgcatcttcatggagctcatcaaccgccagccgctcttccccggacgcgaccacatgcaccagatgcgcctcatcaccgaggtacgtacaacaactccttcacgatccgatcgatgcaccacgatcacttgacggcttttcgccgcctggcaggtgatcgggacgccgacggacgatgagctcgggttcatccggaacgaggacgcgcggaagtacatgcgccacctcccgcagttcccgcggcggccgttcgcgagcctgttcccgaaggtgcagtccgtcgcggcgctggacctcatcgagcggatgctaaccttcaacccgctgcagaggatcacagttgaagaggcgctggagcacccgtacctggagcggttacacgacatcgccgacgagcccatctgcacggagccattctcgttcgacttcgagcagcaggctctgacagaagaccaaatgaagcagctgatattcaacgaggccatcgaaatgaaccccaatttccgatattagattggatatatatatatctagatgcatggttcctcttttatccaccacaatgtttgtacataggcgtgagattattggagagccggggtagactgaacattgcatttgttagtttgctgatgttcgagtccaccatcctggtctgtaaggctgtgtaatctgttgttgcaggtttcaggcgttcctgtaatgagttgtaccaagaataaaaaaaaaggtttggactctgggtcatgtttctcgggcatacagaatcacaat

SEQ ID NO: 172 - DNA, 810 bp, Saccharum
ctaactcttttttttcactctttactgtaatagtatacctcttgtccaaagaatcagatgttgttacatcggaagcagcatccgtcttcgatcattggaaagaattacatttaccctcccatacatgataattcttatgccagcttacattcttgaattgaccgtcacaccaatcagaggtcccaggaggctggtcaggtcttcatgcacagccccctgagaaaaatgaagaatacgctacgttctatagtctgtgtcaatcagatttttgtgcagagtcagtttggtaatagactacatctccagtatcgctaacatagtggtcttgctttaagctttgtgctagcaccccaaataggtgccacgggagaggacccgacttctttggttctttgtagtacttgccaagaaccggttttgctgcctcagtcgcctcaatgagatggtaatgcgggatttggggaaaaaggtgatggatgacatgagttccaatgtcatgatggatattgttgatcaatccatagtcccggtcgagtgtcgtcagtcctccacgcagataactccattcctttccacggtaccagggaagcttgtcttcgtggccatgatggtgcaagtatgtgaccatatccagccaagcaacaaataccaagtatgggactccgtagagctttagcatcggaataggacccatcataaaggtgagaccagccagaacacccaccatggccagccaggacgccgtcgatgttatgatgtccttcttttcattaggttggaacaaatcactgcttgggttgaagtgcgatc

SEQ ID NO: 173 - DNA, 714 bp, Saccharum
ccaaagaaaatgaatggggcacttctctctgcgataatcattccaatagttgctgccattgccttatttgttatctttgctgttctgctgctccgaacactcatggaaaaagctaggagaagggctgctggtcctaaagatgaaacagcattacttgagaaccgagaattctcttacagagaactgaagcatattacaaataactttagcctagagattggcaaaggtgggtttggagctgtcttccttggctacttggaaaatggaaacccagtcgctgtgaaaatacggtcacagtcatcttcacaagggtgtaaagagtttctggctgaggctcaacatttgacaaggatacatcacaagaacttggtatccttgattggttattgcaaggacaaaaatcattttgcccttgtctacgagtacatgcctgaagggaacctgcaggatcatctgagagacacttctactcacaaaccactcacttgggagcaacgccttcaaatcgcccttgatgctgctctaggtctggagtacctgcatgttgcatgtaacccacactgattcacagagatgtgaagagtaggaaacatctcttgacaaccgacttggggcttagattgcagattttgtctgaccaagcttttcatgactcagaaacacattatcaccactgaacccactgggacaaggggctactaaaatcctgagatt

SEQ ID NO: 174 - DNA, 902 bp, Saccharum
ctcgccgggccgatccgggcggaagacattgtcaggtggggagtttggctggggcggcacatctgttaaaagataacgcaggtgtcctaagatgagctcaacgagaacagaaatctcgtgtggaactaaagggtagaagctcgcttcattctcatttccagtatgaatacgatccgtgacagcgtggcggatcgatcctctagaccttcggagtttgaagctagagctgtcattatatgttaccacaggaaccattagcgtgtgtcatgtaagcgttgatagcgacggtactgtttgatctttcgatgtcggctcttcctatcattgtgaagcagaattcaccaagtgttggattgttcacccaccaatagggaacgtgagctgggattagaccgtcgtgagacaggttagttttaccctactgatgaccgtgccgcgatagtaattcaacttagtacgagaggacccgttgattcacacaattggtcatcgcgcttggttgaaaagccagtggcgcgaagctaccgtgtgccggattatgactgaacgcctctaagtcagaatccaagctagcaaccggcgcctgtgcccgccgctcgccccgacccacattagggcgttcgcgccccaagggcccgtgccactggctcagcccgcccggccgacgcgccgcggcgagccgcctcgaagctcccttcccaacgggcggcgggctgaatcctttgcagacgagtccgtgcgacgcagggcattgtaagtcagcccacgcgtccgcccacgcgtccggtgtgtgccgccctagctaggctggggtcggcagtgtaccggtgtttgtccatcgccgctccggccagttcggagatgtgagtaagtagctaggggaataagtgatgtctgtctgg

SEQ ID NO: 175 - DNA, 631 bp, Saccharum
tggtaagccaagtggagtgtagtactactcccccagttaagtcacactaggtagtatagcagcagccatgtcggaggagaagcaccaccacttgttccaccaccacaagaaggacgaggagcagcccaccggcgagtacgggtactccgagaccgtgaccgccgaggtggtgaccaccggcgaggacgagtacgagaagtacaagaaggaggagaaggagcacaagcacaagcagcacctcggcgaggccggcgccatcgccgccggcgccttcgcactttacgagaagcacgaggcgaagaaggatcccgagcacgcgcacaggcacaagatcactgaggaggtcgcggcggcggcggccgtgggcgctggaggctacgccttccacgagcaccacgagaagaagaaggaccacaaggacgccgaggaggccagcggcgagaagaagcaccaccacctcttcggctgaccgtaccggccggtgatgatcgagctccggcgcaccaccacctgtttatttgtgtactgcatgcgtgttaatttgacggttcacaataataggtccctttccggaccttgctaataagctgtcggttgtgtgagtgggactgagaagaggtgtggtggggcc

SEQ ID NO: 176 - DNA, 562 bp, Saccharum
cgcccaccatttccgctccgcctccggtcgaaaccgacgcgctccgctccgctcggcggctccaacaagaaacgcaaggcaggtgctcctccatccattctccgaccgaccatcgtcatggcgaggagggcgacggtgatgctgctcgcgacggcgctcgcggtcctccttctggcggcgtcgtcgtcggcccccgtggccagcgccgcccgggacgaccccacggcggcggcggccgtctcttctcatgaccagggatcggcggcggcggcggaaggcgcggggtgcgagggcgccaacgacgaggacgagtgcatgatgaggcgcacgctgaacgcgcacaccgactacatctacacccagaagcaccacaactgatcgatgatccatccttcctaggctaccatatatgtacgacatgcgttgctccgtgctcgtcgatcgtgttctttatttattcccgtccgtggtgaacactgtgcatggtgcgttacctgcgtgtcaataataataacagtttccatgtcaacgcgatccatcgtggccatcccaaaaaaaaaaa

SEQ ID NO: 177 - DNA, 515 bp, Saccharum
acaatccacacgagcacttgaacgacgcacaggcgctacaacaaacaccaagcatcaccaatggcttactaccaggaggtggactactgctcggaggaggtgaggtcggtggccccggccggtggcttcggccgctacggcggcggcgtccagcagcacgtcgtcaaggagaagttcgaggaggtcgacacggtgtcacgcaccggcggccacaaccaccaccacggtcaccacggccacggcgtcgtggtgcgcgagaccagggtcgaggaggacttcaacacctgcaccggcgagttccatgagcgcaaggagagcttcgtcgccagggctaactgagctgccggccgcacgaccgtaccatgcacgcccgttcgtgccttatgtatgtatgtgcgtatagtaagattgtgcagggtcatcgtacttggctggcgtgcacgcacgcagcttctgtacgaattacgacaataagctcgtgacctgaataaagcttctccgtactacttacgttc

SEQ ID NO: 178 - DNA, 833 bp, Saccharum
  misc_feature 64: n = A,T,C or G
gagttactgaatgttttagttaatagcttctggcagatcttctcttccaaattagattctttanaacttaggttattggatctgtcaaaagtcttcattgaaggcaacctgctgaactcgtcatcttgtaaaattgtttcaggtgcatcagtgggatgttcacatttgttaccatgattgccatcaacagaatcgaccaaatcttgttcgttcaatgggtaaacctccccatcactttcactgtcagactcactaataagttcatcttccatcacaaaagcatcatcagatggcttgaaccttgacggagaaggaggatcgctgtgacatttatatttgggtttatctgggctgatcttattcaatgtttcacgaataatatgctcccacattgcaacagggcggttgtcttcagcaccaaatatattcccagcatttagtggaacaatttcttgaaatccaagaacatatatatcagctggctcctccatatccaaccattcttgaatattcaagtcattaggtggaagtctgcctgcaacattccatgttccagcacaaatcctgagttccctgacatcaatatactgagcacgaagggtctctgacttgcgccttctatgaagcccacagggagccaccccgagttggtttcctacaatatttgatagattttatcagtgcatacggaaaggttcaccttctcgcaagtgtatatttttacctttttaatgaataagtgtgtatgcttcaaaggcgctttagagatacttatctgaaattagtgatacaacagactagcagtagatcttagtttgtcagtgtgctgcatg

SEQ ID NO: 179 - DNA, 1180 bp, Saccharum
ccggaccggaaatcccgggacgacccacgcgaccgagcagttccaagcctggtgtgttggttacaagggcagcagcagtcctggatggggagagtgcagaggtggataggcttgtgcaaagaggaagggccaccacctgttatagaggaccgacggccaaggaagaggggaagaaaacctgcaaacgggagggaagaaccacttaatcatgtcgctgaccctgttcaagctgccggggctcacgggctccatcccgacctgcctcaccgcgctgtccaagctggagttcctcaccatctcccacaccagcgtgtccggcgccatcccggagtccctggcgcggctgcgcagcctcgactccgtggacctctccagcaaccagctgacgggcggcatcccggcgtcgttcgccgacctgcccaacctccggtcgctggacctccggcacaaccagctgacgggcaccatcccggcggggctggtgcaggggcagttccggtcgctgatcctgtcctacaaccagctgacgggcccgatcccgcgcgacgacgcgcacgacgagatcaacaccgtggacctctcccacaacaagctcaccggcgacccctccacacctgttcgtccccggccggcccatcggcaaggtggacctgtcgtggaactacctcgacttcgacctcagtaagctggtgttcccgccggagctgacgtacctggacctgtcccacaaccaaatccggggcaccgtgccgctgtcgctggagcggctgtccacgctgcagaagctggacctcagctacaaccgcctgtgcgggccgctccccaagggccacggcgtgatcaagcacgggtgcaagccgtacgcgcacaaccagtgccgcaaggggaccccgctcgcggggtgccaggacctggagtgagctgtgagccggtcgcccggagcggggtttctctgctctccctcgtcggcgtgcggcggcgcacgtgtgcttttcgcgtgtttagctatagacaaaagtacggccgcgtggtggtggtaatatgctttagctacgcgaccggttgatcttgagcagttaagcgtgtacgaaacgacagctgtgtacgtgtactgtctgctgaagtgtgcgatgtagtactgtgtatttggtatggatccgatccatcggcctgatgtatg

SEQ ID NO: 180 - DNA, 1518 bp, Saccharum
aactagaatggaattaagacctcttgaaattataacgtaattcatcagaatggaatacagtcagcctttgctacccacgcaaaaataaagaaagagaaaaaaaattgatttcgaactaatgaacaatgaacactccattctttctccctatgcgtttttctgttcagcagatgggcagtggctcgccgttccactccttgaggcactcgagcagcgggtcgatgtgcttgccctggttgatgaaaaggagcaccttgttgagctcctcaccgggagagcgcgtcttctcgccggtgaggtacacggctccgagctcctcgcgcacgaagcggtagagcgggtaggagcggcactcggtgattctgtttggtatcgctgccgtgccgttctcgacagccgcccgtgcagcctccaccgccttgggcagcgccgcgcgcagctcctcctcgaactgggcgaccttggcgaacacggatgtctcggcgtcgaactcggcagcgccgttggcgagggcgcgctccacgagcacgttgcgaagcttcttcatcagcgggtagttggcgctgcaggggtcgtcggcgtacgcgaacaccgcctcgcgctcgatctcctggagcaggtccttctcgcagaagcgggcgacgtggagaccaccggtggagttggtgctcagagtcttcttcgccaccgtcatcacgcagctcttgacggcgctcttgacgttctcctcgatgtgccgcaggtcgacggcctggcacagggcgatcaggaacgtcgaggacatgagcttcaggatctcgatggcctcagcagtcttcctggaggagatgagtccgagcgagttcacgtcctggttgtgctgctccgcgctctggacgtggttggtgaccgggttccccaggaactgcagctcagagcagtaggacgccatggcgatctcggcgcccttgaagccgtagtccaagctggggttgcgcccgccggacaggttggagggcaagccgttgttgtagtagtcgttgacgagctcagagaactgcgcaaacatgagcttgccgatggctgcgatggcgagacgggtgttgtccatggacaccccgatgggcgtgccctggaagttgccaccgtgaagagccttgcttcgggcgacatcgatgagcgggttgtcgttgacggagttgatctcgcgctcaatggacttggtggcggcacggataacctcaatctgggggccaagccactgcggcgacgtgcggagcgcgtaccggtcctgcttcggcttcatcagcgggtcgagctcgccgagcttcttggcaagcttcatgtaggagctgccctccaagatgtgctccatgatggcagcagcctcgatctgtcccgggtggtgcttcagcttgtgcgtcaggtggtcggtatactccggcttgccgttcatgacctcgcagaacacggcggacaggacctcggcaaggacggcaagtatgttcgcctcaaagagcaccgtggaggcaagtccgg

SEQ ID NO: 181 - DNA, 1181 bp, Saccharum
aaaccaaaccgcctctaaatttaaatttacaacatataaattacggataagtttttgagaacataaccatgtaaatatccaacaccattcctcagctacatgtacccccatcttcactctagactcgagggccaaacacaaacaacagacgcatctcctcttagtacaaaaaacaaaaacaaaaagacagaaaaaaaacaaaatacatagtgctggatctgcgggggcgcgtgcatggaacacgcattgatctctaggcctcgaggggcttgcagacgatggtggcgtgcttggcgatctggttgctgaactggccgggcttctccgtggtgtcgatcttatcctggcccggcggcggcagcagctggaagttctgcacgagcctgcccagggtgatgccgatgataggcagcgcaaggatgatcccggggcagctccggcggccgacgccgaagggcacgaagcggaagtcgttgccgtgtgcctccacggtcttctcctcctccaggaagcgctccggccggaactcgtcgggccgcccccacctcttggggtcgttggcgaggaaccaggcgttgacgaggatcttggactcggcggggatgtcgtagccgacgagcttgccgtcgtggaggttcatgtggggcaccagcagcgggatggccatccgcagccgcagcgtctccttgatcaccgcctgcaggtaggggaggttgtgcgtgtccggctccgtgatctggtggcccggccccagcaccgtgtccagctcctgccgcagcttctgctggatctcagggtggttcaccagctccgcgatcgcccactcgatcgaccacagcgttgtctcgatcgctgcaacgttaatattctcgacgatgtagagcacgttgtcctcgttgatctcacccttctgctgcgcctccaggatgtgatcaatggcgcacttgagcccgttgctgtccatggccttggtgctcgccagcttcttcctctcctcgaggaagaaatccttgaagagcttgaggcgggtctccttgacctccttgcagatcctgaggtagccgcggaggaacgggcggaggatggggatgaagtcgccgtagttgtactcgaagctctgcgcgaggcggctgcgctcgccgttgagcgccctgaggcggaggaagagcgggtcgtccatg

SEQ ID NO: 182 - DNA, 584 bp, Saccharum
cctaccacataattcatgcaatgtactagtactcacacttagtaaataataaagcacccatcctaggcacagctgctgttacaaaatacatataatatatacggacgtgttcgtatatgtggcagaaaccacatcgtccacagcacatataatgggtcactcactcatcagagaccagtgggcaggaacaactctaacatgtgcacgcatgtggttccggaagcaggatgagcttctcctttcgacggactgtcaatccaaacacctctgtcatatcaatatcctcttccttcatgccaatgggcagaccccagtcaaaaagtagacgaggtttgccaacataatctcaacagtagccaggccaaagttgaggccagggcagatcctccggccagcaccgaacggcacgaactggaagtcgtttcccctcaagtcaatggccgcagcgctggcagcgtccatgaacctctccggcacgaactcctccgcgctctcccaggactctggatccctactgatggcccatgcgttgatgatgactcgtgttcccgaggggattctgtagccatccacgtcacagtcca

SEQ ID NO: 183 - DNA, 1372 bp, Saccharum
cctccttctcaccagcctcaggcctcagcctcacgaaaaggcaggcaaggcgaaggccaaggccaaggccaagccgtcccctccctcctcagttcgtccgttccattccacccccttatctaatcctggtccctggaccccggcctgcaacccccagcagcagcggcgccggcgaggggagtctgagcctctctgctcaaaggaagaatttttagcgagattgagatccggaggatgccttccagggccatgaaccggctgttcgtcgagtccgcctccggcagcggcggctgccgggacgccgagccggtgctctgcgcgcctcggccgcgcagggtccaggtccacccctgcagcgccgacctcatccttggcccgccgcccttcctgctcaacaagagcagcaaggaaggaggcaggaccaagccggcggaggaggaggaggaggacgggggctgctgggcggtgttcggcggctcgccgccggcgcgcgcggacaacccgctggtgcatgacccccacttcctgctgaaccagcgccaccccgcggcggacccgacgccgctggagctcgggttttttgaccaccggagccgcaccagctacgtccaccggccgacgtatactagcagtaacagcagcagcagcagtaacaacagttttgcaccgtcgtcgttcgcgccggccgtgaggatccaggggttcgacgtcgccgcgtgccggagctcccacagcaacggcggcagccgcgtgctgtcggcccgcgcctgagcgagctccggccggggcggcgccgagcccgcccgccctcccccgtccagggaggaggaggaggagagacctcaagaatcttgtacagttttcgccgtccggccgaccgtcgtactacttccaccacgatgatgatgctacgtgtgctccgttcgtctttcttgtggtatactatacagcagcgggtttttcatttttattaacagcagttcagttcagatcagatcagaatagagaggcgaggggagatgagatctcctctctcgccaagaagaagagtactagtaatagattgatgttcgccgataccacaccacacagcaagagggatggtcaaagggagagaacaaactgaaattttttttcctcatattttttttactgggttttgtcagcaaggtgttgtaaactatagcatggatcgatccatctcttgttcgttgctgtgatctgggtgcactacctgtagatataaaatcagcacccaggtcggtcagcgttcgtgttcttgtagttgagggggaaaaaaagatgtcggcttctcgctttgcttaagcgagcgacgaagctaccgccatgtaaccatggttgtactcctaca

SEQ ID NO: 184 - DNA, 1029 bp, Saccharum
agttggaaattacacaattacgacgaaactcatacaaagacatgaatatacacaatacaaagggtaaattatagttggaagctacacaattactactgtgcaaaataaggcatgacacgttcgtataacacactgcacaggatggacccaagcacatctgcgtcctgtgcagtgtcggattattcagatatccgcggtccggtactaatcacagcacagcaacaggtgacgataagcaggtagccatggatcacatgacagagcaggagttctcatcggtgacgacattgcagccggcccacgggggcggccaaaccggcggctgcggtggccaggccggtggtgtctggccgcagccacagttggcgtggctcgaacagctgcacggtggtggcggcggcggcagaaaaggaggctgcttctggcagcactggcactgctggtgaggagggcactgccacggccagctctggcacatcacggggttcggcaccgggtacgggtacggcacgagcttgtactctgtcttgggcggcgccggcttaggcttttcctcaggcttagacttgggcttgcagtggtcacagacacagcatttctcaggcttgggcttgcagtgctcacagacacaacatttcttctcaggcttgcagtcctctggctttggtttgcaaggagtgcatggcttggttggtttgcaaggagtgcatggcttggttggtttgcaaggagtgcatggcttgggtggcggtggcatcggccacacctcggcgatgacgatctccttcacgaccttcccggccatgcaccagaccttcttgcagagcttctcagcgtcaaatttcccgcgcaccaccaccaccttcttctccttcttgtcctcgaactccaccttctcgatgcagaactcctctttgaggcagtccaggaccttggtgatcttggctctgcagcgacagcattctaggtccaccgtaatcaccagtatacccatctttcagctatgggagctggcgatgagcaagagag

SEQ ID NO: 185 - DNA, 797 bp, Saccharum
tgcagctaccccaggccgatccatggcatcctgggcaagtcctccatgctcgtggtcctgggcgaggaccacaagcgcctcaggaacctcgccctcgccctcgtcacctccaccaagctcaagcccagctacctcggcgacatcgagaagatcgcgctgcacgtcgtcggcgcatggcgacacgacggcggcggcgtcagggtcgtcgccttctgcgaggaggcaagaaagtttgcattcagcgtgatagtgaagcaggtgctggggctgtcaccagaggagccggtcactgcgaggatactggaggacttcctggccttcatgaagggcctcatctccttccctctctacatcccagggaccccatatgccaaggctgtccaggcaagagagaggatatccaacactgtgaagggcatcatcaaggagcggaggagtgctgggtcatgcaacaagggcgacttccttgacgtgctgctgtcaagcaacgagctctctgacgaggagaaagtgagcttcgtgctggactccctgctgggaggatatgagaccacctcgctgctcatctccatggtcgtttacttccttgggcagtctgctcaagatctggacctggttaagagggagcacgacagcataagatccaacaaagggaaggaggagtgcttgacttcagaagactacaagaagatggaatatactcaacaagttatcaacgaggcgctgagatgtggcaacattgtcaagtttgtgcaccggaaggcgctcaaagatgtcaaatacaaagagtatctgat

SEQ ID NO: 186 - DNA, 517 bp, Saccharum
aaactgaacatgaagatgaagcccatagatttgagggaaaagggcatgaacatcatgaccctgtaaccagtctgccttttgagttctcccattattatcatggaagtagctatgacatggggacactcattgaggtccgtcgaatgtgggattcgttcatcagacctggaggaagccgtatacctgggcactgggttcaaccaccccctccagctgatgaggtttgggcatcttatttggtgcaacccaagtaaatccccatgggttcgagaaatggccatttttgcttcaaaaccaccgaaatcttcatggctcctgcaaggtggcaagaaaagcatgctgaaggaaagagcaaagactggacactggtgctcaagagtaaagttcgtgaattataaggtaaatttgtaatataatcctaaacctgtaagtgtcagctccttgaccttgagctagctcatggcagtgaaagctgtgtggtggatttgttttcctcttaatgaaacacattcgtagg

SEQ ID NO: 187 - DNA, 1249 bp, Saccharum
gttatcactgctacttattataccagtcatcgtcctggagcaaagttacatgaaacaggcgccagcttggcagtttcgccctagtcacacacacaacgtaagtccagcttacgtcaccaaaagaaccagcattccgcacctgcatcaactccgccctctagtccagacccaacgagcgtcccaggtactagaactgagcgactgccaattcggacacacctagtttagttacagttacagctgcagagacaccccgagttcagttcagtttagacaagagccagagtcgaaatcgctgataagccaaggatgagttgccagttgggggctggctccctacgcgccgccccctctcgcgtgatagtggtggcgatcgccgggtggcaagctgtgctcgtgcttcgtgaacaggccaccgttcgtgggcacgcgctgcgcgtctgaggagccgccgacaccgctgccgggggactccggctgctgcttcgtgttcaggaaccgcccgcctgttccccgggctctcttcatcgcatgcagatgccgagactcgtggaggtacggcttgcgacttttgacaagcttgttttcagcctctagctttgcacggagctgtctccttcggagaatcgcgtggtattgcttcgcgttgacataaatgggctcttcagcggctggctcaattggtaatggcactcgagaggacgaaaccatgcccaccagctgagggtgcataatagcaggtgagccataagctgccactgcaccaccatagtatggatcagcatatgggtatgatatagcaaaggactgagtacggtcaggctttggatgtgcataacccgtttctggattacccagggataaagctgacatcatcttgttttcatcactctttgagtaaccatcaagattacctgaatgatcattatgctcgttgaggcttccttcgctcattccagacacttcttgatggctctcactggttgactgggtagctggggagtcgtaatcaggcatttgatgaccaaattgaatcattaccgtgccattctgtctcatcgcatggaaattctttattcttgtttttcagttcatactgtgagatgaggagggagcatgttccccttccggcagcccgccgccgttgctgcctctttcccaccttgctttgcttcgctcgtctgcaaggtctcctccctccccctcctcccctctctctctctctctctcgcactcgcagacagagggc

SEQ ID NO: 188 - DNA, 777 bp, Saccharum
gagaaacaaccgacaaaaaaattatttggaagacagcaggataatagcagcactattataccaatattaacgtacttagttcgataacccacacgcatccagccccatacattgcaggctagcaaaagtaaaccacacaaaataaaccgataactcgagatgttcagacacgataaccagaatagctaagctaactcgctcttccgccaggactctaggtaaggcttagtcgacctcctccatcttgctctcgccagcgtcgtcctccagagggggcatgtcagtgtcagcctcaggggcctcgtcctcatcaatgctcaggcccagcttgagcatgcggtggatgcggctgccgaaggtgttggggtcgtcgaggctgaagccagaggtgagcagcgccgtctcgaacagcagcatgacaaggtccttgacagacttgtcgttcttgtcggcctccgcgcgcttgcgcagctcctccatgatggcgttctccgggttgatctccatcgtcttcttggaggacatgtacccagacatgctggagtccctgagcgcctgggccttcatgatcctctccatgttagcagtccagccgtactcacccgtgacgaggcagcagggggagtccaccacacggtcagagaccaccaccttctccaccttgtcgcccagcacctccttgatcaccttgcagaggccctcgaacttctccttgagctcctcctttttcttcttctcatcctcgctctcatcaagcttcaaggcctccttggtggg

SEQ ID NO: 189 - DNA, 714 bp, Saccharum
aaacaactaattaatgatccatcaatcgaaatgtatggaggataatgtgcagaggatctggataacgcatatgaggaggcacatcccgcacccaacggagagggacgagtagaacagcagcagggagaaacggttgtagaagaacatggagctgagtatcaacaccaggcacatgcacaacacgcccaacgcggtgagtcgcgccatgcgtccagattcttcttcagccgggattggagactgacaccagcagtaacaaagaaagaaggaaggaatcacatctcagatcgacaccatatttcacagcgggcgccacggagtcacgcgcaccacgtcccccatcacatcatcagatcacctggcaggggaccgtgtgctccggctggctacttggtgatggcccagacggcgtagatgatgccggggaggtagccgaagaaggtgaggatgaggcagatccagaactcaaccccgcagccgaacttgaagaagaccccgagcggcggcaggatgatggcgaggatgatgtcgatgcaggtcgccgtgccgtccgacatcttgctacctgcttgtgcgtgcggctaccttttaaacgctcttcgtggcgagccctgcagctgcaggctaggaccccgtcgatcgacggcggacggccgaaggcagaaagaaggcaggcaaggtgggggtgcgtgtggtggtgaatgcgatgagctg

SEQ ID NO: 190 - DNA, 632 bp, Saccharum
ggtttgaatatgatcatcttattcaggatacgacctgcatatggcatatttacatcaggacgtgcacggaagctagctagctcggtgctcacggcttcctccgcgggcgagtcatcatgaccataaactcgtccatgtccacgaagccatcgccattcctgtcgatctccctcaccatcttctggcagtcgtccaggctgcagctctgcccgagtttgtgcaggaccgtcatgacctcctccgcgctgatcctgccatccccgtccctgtcgaacacaaagaaggcccgccggatgtccctgagctgcacgccgttccggtgcacctccatgaattcctccaggtccatgtacccgtccttgttgtggtccgcgacgcacatcatccgccgcgcctcggtggcggcgtccgccttccccaacctctccaggagctgctggaggtctttcttgttgatcccacggggttggctagctatcatgttgaaaactttcttcatctcctcgtcgtcgggcttgtaggtactcaggtcggagaactgccggtccctggccgacagcgggccggccttggaccggagcttcgcgagattgtacttgaaggagagaatgctcagatgagacatttttttt

SEQ ID NO: 191 - DNA, 1151 bp, Saccharum
  misc_feature 931, 946, 1115: n = A,T,C or G
ccacgcgtccgagcagctccacaacaattcgtgcctgcctgccctgcctcctcctcgtcctccccacctcgccgcccccgccccggcccccacaccacgcgcgcgcgcggcgctcgaggcgacgaatccggccacctcctccgcgcccgtccccgccgccggtcgccgatattggaaggagctcggagggctgggacgctgacccgagttttatggggagaggatgccagagctgcgaagcaatactcgtcaagcacgcctgaggtctaagaagctcgacgatctgcagccaggagagccgcctgcgaaaccggtgccacctgctccgcagagggcagcaaagcgtgctcctacacgtgctgctaggggcagaaagggtgccgctgggagaggagcacctcccgcaccaaagcctagaagaaagggggttgagattgccgacttagaagctgatccagcttgtgaagacccccctaaagctgtcaagggactggaagtcgcccctaaagctgtcaagggactggaagttgctgctgctgcacccaagaaccttcctttgaagaaggtagccaaggttggtgttctgaaaatggatggtgaaagtgcggagaagattgttggggctgaagatgaatcgacagctacacctgtcccagagagggttcatgtaggtaattctccagagtacataactgacaggaagttaggtaaaggcggttttggtcaggtctatgttggtcgaagggtttctggtggaaatgctcgcactggacctgatgcatatgaggtcgcattgaaattcgagcatcggaacagtaaaggatgcaattatggccccccatacgagtggcaggtttataacactctcaatggttgctatggcataccatcggtccactacaagggtcgtcagggcgactactatatactngtaatggatatgctnggtcccagcctttgggacgtgtggaattcaatggggcagacgatgtctgcaaatatggctgcttgcattgctgtagagggcatatcgattcttgagaagctccattctaaaaggtttgtgcatggtgatgtgaaaccagagaattttctgcttggtcagcctggatctnctgacgataagaagctttaccttatagatcttggtt

SEQ ID NO: 192 - DNA, 887 bp, Saccharum
ccttgttcctagcaatcacaccgccctctctagttccgcccccaaattaatcccacttccagatccattgttgatttctcaagcttcgcctctccatattacccaatgtgatcactgactaccaataccctagtcacgcgtcgccatgaccacgcgcccctccgtgctcacgctcctcctcctactcgccgtccagctccctcccgccgccgccgccgccgccaagcaccgccacgcgtccgaatccgccccggcaccacccgcctcctacctcctcgtatcgtgggcaagcaacctcacgctcctgggctccgcctccctccacccgggcgccacagccgtcgcgctcaccaccccgtcccgtgacggcgtcggtgccgggcgcgccctcttctcggagcccgtccgcctcttcgtcccctcctcctccgcagccgcctccttctctacccgcttcaccttccgcatcacgcccgcgcccacctacggtgacggcctcgccttcctcctaacctcttcccggactttcctcggcgcctccaacgggttcctcggcctcttcccctcctcctccgcctcggacgagggcgaggccgacctccgcggcgtcaccaccgtagccgtcgagttcgacacccaccgcgacgtggcgctgcgtgacccggacggcaaccacgtcgcgctcgacgcgggttccatcttctccgtcgcgtccgcgagccccggcgtcgacctcagggcaggcgtacccatcaccggctgggtggagtaccgcgccccacgccgccgactcagcgtgtggctctcgtactcgtcgttcccgccgcccagagaagcccgccctctctgctgatgccgacctctccgggactctgcgcacatacatg

SEQ ID NO: 193 - DNA, 701 bp, Saccharum
aggagttaccaagaactaagctaagtgatcatattgagcaaagacttttagagaggcttgacagacagcaacagagggcgagcgcctctggaaaagttgctgaagaggtaccaggtgtgaaaggtcttacagttagagtagtttcttcagctgaaagaatactacaagtccaaccacgttttcgtgatttttttaaacaagaaaagtatcctggggaatttccatacaaatcaaaggccattctcttgtttcaaaagattgaaggtgtggatgtttgcctgtttgccatgtatgtacaagagtacggttcggactgcccatcaccaaatcagagacatgtttatcttgcatatatcgattctgtcaaatatttccggcctgaaatcaaatctgcaagtggagaagctctccgcacctttgtgtatcatgaaattttgattggttatctggactactgcaagaaacggggatttgtaagctgttccatatgggcttgcccatctactaagcgtgatgattatgttttatattgtcatccaacagttcaaaagatgcccaagtctgacaagcttcgaagctggtaccagaacttggtcaagaaggccgttaaggagggtgtttgtgtggagcgtaatacactctgtgacttcttccttcagcctacaaatgagtgcaaggccaatatttcagcagcatgcttg

SEQ ID NO: 194 - DNA, 682 bp, Saccharum
cccacgcgtccgcctcgttccgatttgcatttgttgcgagcttcgtgttcttgtttgcgaggagaggaagaggacgactgcgagcgaggagaggaggatgtcgtgctgcggaggcaactgcgggtgcggcagcggctgcggagggtgcaagatgtacccggacatggctgagcaggtgaccaccaccacccagactctcatcatgggtgttgcaccatccaaggggcacaccgagggcgggttcgaggcggcggccaccggagctgagaacgacgggtgcaagtgcggccccaactgcagctgcaacccctgcacctgcaagtgaggcgatggcgatgaccctgcagggtgcaggccgtgatgaggaaggagatagctagtatagcagtgtgtgtcgtttgagtttcagtcagtctgtcagtcagtcgcgtgccatggcatgcgtagttctcgctcgcatgccgctagtagtggtggtacagatgggaacgaataattgtactgagatgttggcgtcgtgtcctgtccttcctcccctgcccctggggctcatctagcagtcagtgttgtgttgtctgggtgcaccacagcagcatgccatgcccatgctctgtttgcacgtcgcgtgcgactttgttggtgctgtgtcaccatccatctatatctatatcccatctttgtg

SEQ ID NO: 195 - DNA, 723 bp, Saccharum
aaagcatggttctggatcaagaaaccaaccgacccaaaaagaggaactactaacctgactaaaatggtgtatatcgagtagcaagctcatatgatatgaccctattatcagtataaacatgtgccctcactcacaaccatggcccgaacttttttacagtggaaaaaacagatgcagcaacaacgtacgtacgtgttgctatgccgtcacttcttcctgggcttggaccggcggcgtgccttgccggcgccgccagagcccccgccgaagatggcgcagaggatgcagccggacaccctcggagagggcgggtccatgtcgggggccacgtccttggtccggaacacctgctgctggttgctgcgcgcctcctccttgtgcccctgcttctgcttcttctccttcgccttcttgttatcgctgtccccaccgccacggtgcagcatgccgatgctcccgacgctcctggagtgccggagctccggctggggatcctctgcggtgccatcgccggccttcgcctcggcgtcagcctcagtcaggaaacgctcgtcccagaccaggcccgaggagccagaccttctgaacgtcgtcgccgatctttgcaacccagccatgggtgccgcctatccacctcccgtctctgcgagaaggaccagcttatctgcaagtgtggagaacaaagggtgagaacgaactagacggtgtgcttctgctgagtat

SEQ ID NO: 196 - DNA, 1093 bp, Saccharum
gaggaggaaacaaacactgcatacattactccaacacagctttcttgtgtttttctttctgaagtacaccatcatcaccgttctatagctgataacaggcacacttgcatggccaatacaggatcaggaagaaacacacaggtacaagcacatatagcattagcaatgtcacacgtccttttatgtctaataactggaacaataagctctgtgcagtgaagtactgtcgcaatcacagccatcagcattgagagctctgtatccatgtttagtacggcgtattctcagtaagggacgatgatggattcgatgagctcctggagtggagccagctccttcttgtcaatcaggccaaactcatttgtaaacagaatgaagtgcttgaaacaggtattgagatgggcctcctctttaaggctaacaatcttctggaaatgagagtggtagatgtgggcatagacacgaaacaagcgcttgaatattgtcttcactacttccttgaagtttggcgggaatggtgtgccaagtttttgaggaaatatggattcatcatcaagctggccttcaatccaatccatcagatactccacgtattttggtgctgatacctctatgggtttctttatctgcacgccatcagcccatctgtactcgtactttgggccagctgtcattgtcgggcagctctcaggcgtgcagaattctgtgagtgtgccatacagcagattaacttggttaaagaaatccacagtattcacagcaagccattcattgatatcctctccaggaggcaacctcacagcttccctaaggtttccactgccgagagtggcatctatgtgctttcggagctgcgctcccttgctgcctgatggagcgctcttcttggggcggaatgtcttctgattccgcccaagcccgaagagactcatccctcctcctcctcttcctcgtccgatccggcgcgccgccgagcagtggaggagagtggagacggcgacggctggacctgctgcttttggcgcacgcagcgagcgactgcgaggagccgagaggacgaagagggccgaggtgggagggccggggacgcgtg

SEQ ID NO: 197 - DNA, 725 bp, Saccharum
ctccagcgttcagcattagacacgcacaaggaagaaacagtagccggagagagctccaatctagccagtccagtagtcccgcgagctcgtcgagagaaacagagagagcaacatggcgcctgcattgtcattcccgatcatcgacatggggctgctcgccggggaggagaggccggcggcgatggagctgctgcgcgatgcgtgcgagaactggggcttcttcgagattctgaaccacggcatctcgacggagctgatggacgaggtagagaagctgaccaaggaccactataagcgggtgcgcgagcagaggttcctcgagttcgccagcaagacgctcaaggacgcgcaggacgtcaaggcggcggagaacctggactgggagagcaccttcttcgtccgccacctcccggaatccaacatcgccgagataccggacctcgacgacgactaccggcgcgcgatgaggcggtttgccggcgagctggaggcgctggcggagcggctgctggaccttctgtgcgagaacctgggcctcgacaggggctacctggcgcgggcgttccgcgggccccgcacgggcgccccgacgttcggcaccaaggtgagcagctacccgccgtgcccgcgcccggacctcgtgagcggcctgcgcgcgcacaccgacgccggcggcatcatcctggtgttccaggacgaacgcgtgggcgggctccagctgctca

SEQ ID NO: 198 - DNA, 2668 bp, Saccharum
  misc_feature 1574, 1575, 1576, 1577, 1578, 1579, 1580, 1581, 1582, 1583,1584, 1585, 1586, 1587, 1588, 1589, 1590, 1591, 1592, 1593,1594, 1595, 1596, 1597, 1598, 1599: n = A,T,C or G
ctacgataagcttgttggccaccagttagcttgttgttgttagttctctgtgccagcagcatccggtaggaaaaatgactgggaaggtaacattggaggcggtgaggaaggcgcagcgcgccgagggacctgctgcggtgttggccattgggacggcgacacccgcaaactgcgtgtatcaggctgactacccggactactacttccgggtcaccaagagcgaacaccttaccgacctcaaggaaaaattcaagaggatatgccacaagtcgatgattacgaagcgttacatgcatttgactgagggcttcctacaggagaaccccaacatgagctcgtactcggcaccatccctagacgcacgccaggatatcctgatagaggaggtacccaagctgggcgcggcggcggccgagaaggcgctcaaagagtggggccagccacgttcccagatcacgcacctcgtcttctgcaccacctctggcgtggacatgcctggcgccgactaccagctcatcaagctactcggtctatccctctctgtgaaccgagcgatgatgtaccaccaaggttgcttcgccggcggaatggtgctccgtcttgccaaggaccttgccgagaacaaccgtggtgcccgggtgctcatcgtgtgctctgagatcactgcggtcacattccgcgggccttcagagtctcaccttgactcgcttgttggccaagctctcttcggtgacggcgcagctgcggtgatcgtcggtgcagaccccagtgagcccgcagagtggccattgttccagctagtatcagcgagccagaccattctcccaaactcggagggtgccatcgagggccacctccgtgaggtggggctcaccttccatctccaggacagggttccacagcttatctccacgaacattgagcgcttgctggaagacgctttcacgccgctaggcatctctgattggaactccatcttttgggtggcgcaccctggcggtccagccatactgaacatggtggaggccaaggctggccttgacaaggcccgactgtgtgccacccgccacatcctcgcagagtatggcaacatgtcaagcgcctgtgtcctcttcatcctcgatgagatgcgaaacaagtctgccaaggacggacacaccacaactggggagggcatggagtggggtgtcctcttcggctttggccccggcctcaccgtcgagaccatcgttcttcagagcgttcccatcaccacagtgcacgccgcatgaccgttgtgcatcagtgcatgtagctccgcgtgacgcatggtcgtggcaattcacctctacagtactttacagtttattttggtttctcacacaaataatgtactgctagaagcaccttgcatgtgttttgtgtgcttgcagtctgtctttacgaataactatgtgtgttgctgcggagatctgtgctagtgttaaatggataaagcatgtacgagtcaatacagtgaagtggggctgtaatattatagttattgtcaacaagagacaatggaattgaaatggcatggcatcgatgttttcaannnnnnnnnnnnnnnnnnnnnnnnnnaagcagccatggtggacctctgccccccgcgccagcaataataccacccccacccacaacgcccgttgccgctggttgtgctgccaccgcccagcgcccaggctctctcagcttcgctcggctctcactgttcgtatcagctcgtcgatgccccacgccgccgccgccagccatgggcaagaagggcggcacgtcgtggctcaccgccgtcaagcgcgccttccgctcgccctctaaggacgacagcagcagccccaccaggaaggcgtcgagcctccgcgaggacgccgacggcgacgacgacaaggggaagcgggagcagcggcggagatggctgttccgtcgttcctcgtccccgtccccatcaccagcaccagctcccgcgccgacagcgccagaccacgcgcacccgcggccagcggccgtgacggaggagcagcgacacgccatcgcgctggccgtggcgacggcggcgacggccgaggcggcggtggctacagcacaggcggccgccctttttttttttttttttttagcaaaagagttgcacaagtttatttatacaacaagaagctcaccgatggactgcttatagaaacacgcacacacccagtaacacgtggctggcgcgcctggtcatgccactattttcctgacgacacacatacgcatatatagccatacgtgttagtattacggcctttccctgacgaaactggcattacatatatgacaggagcggtcactgattagctgtgcgcaataggcaccgagacaaagctgtcgggaatttcatccacatccccgacacggacaacgctgacggtcaggctcctggtcaccttgggcgtcgcagtgtgtgacggcttggtggcgaggttgttcgcctcgatcctctccaccttcttcaccctcactacactctcaattggaagctcgttgctcacgctcgccctagggttggcccggaacattttgaataccctttctttctttcgatgtatgtatggtagtgtgattgatggacttcgctaatcgatgctgatttctagctagacccacgcgtccg

SEQ ID NO: 199 - DNA, 604 bp, Saccharum
caacaactgaccaaccccaaaaaggccaaaacccttccccatccgaggccgtctcgctactcacctcccgcaccccgcaccgccgccgccgtctcgcacgcggggcacaaggacgcgcgcgatcccctcgcgtccggatcgccatggcctccacggcgttcgccgccgccaaattcttcccggcccacctcgactcctccccgcggatcgcgccccaccgcgccgcgcccaccgcgaatctcaccttctcaccgctctccgccaactcctcgtccctgctccgcctccggtccccctgcccgtccgggccggggggtaggctgcccccgccgcgatcgtacggcggcgccggcggatctggcgacgccgcggactccggcggcagcggcgacggccgccgcgggggcatcctggggatcttcctcgccgggtgggccgcccgcgtcgccgcggacccgcagttccctttcaaggtgctcatggaggagctcgtcggcgtcaccgcctgcgtgctgggcgacatggcctcccgccccaacttcggcctcaacgagctcgacttcgtcttctccaccctcgtcgtcggatccatcctcaacttcgt

SEQ ID NO: 200 - DNA, 646 bp, Saccharum
cggacgcgtgggtcctcatcggcgacaacggcgtgctccggatcgccgacttcgggctcgccaccttcttcgaccccggcaagacgcagcccatgaccagccgcgtcgtcacgctctggtaccgcccgccggagctcctgctcggcgccaccgagtacggcgtcgccgtggacctgtggagcaccggctgcatcctagccgagctgctcgcgggcaagcccatcatgcccggccagaccgagatcgagcagctgcacaagatcttcaagctctgcggctcgccgtccgaggactactgggccaaggcgaagctacccgacgtgacgctcttcaagccgcagcggccgtaccggcgcaagatcgccgagacgttcaaggacttccctcccacggccctggcgctcctggacacgctgctcgccatcgagccgtcggcccggggcacggtggcctctgctctggacagcgagttcttcaagaccaagccgctggcgtgtgatccggcgagcctgcccaagtacccgccctgcaaggagtacgacgccaagctctgaggccaggaggccagcaggcaaaacgcagcgggcatcggagggaagggctctgtatccggcaaaccggggagagacgacgccaagggcgccgc

SEQ ID NO: 201 - DNA, 1230 bp, Saccharum
acgcgtccgcttgtgttgttcgccgcacaccgccgcacacagcccgatcccgatccctcttctcgcgagcctcgtcgatccccccttccctcgcttcaagatgcagatctttgtgaagaccctcaccggcaagactatcaccctcgaggtggagtcttctgacaccattgacaacgtcaaggctaagatccaggacaaggagggcattcccccggaccagcagcggctcatcttcgccggcaagcagctggaggacgggcgcactcttgctgattacaacatccagaaggagagcaccctccacttggtgctgcgcctcaggggaggcatgcagatcttcgtgaagacccttactggcaagacgatcacccttgaggtggagtcctctgacaccatcgacaacgtcaaggccaagatccaggacaaggagggcatccctccggaccagcagcggctcatcttcgctggcaagcagctggaggacgggcgcactcttgctgattacaacatccagaaggagagcaccctccacctggtgctgcgcctcaggggaggcatgcagatcttcgtgaagacccttactggcaagacaatcacccttgaggtggagtcctctgacaccatcgacaatgtcaaggccaagatccaggacaaggagggcatcccgccggaccagcagcgtcttatcttcgctggcaagcagctggaggatggccgtacccttgcagactacaacatccagaaggagagcaccctccacctggtgctgcgcctcaggggaggaatgcagatctttgtgaagaccttgactggcaagaccataacactggaggttgagagctccgacaccatcgacaacgtgaaggccaagatccaggacaaggaggggatccccccggaccagcagcgtctgatcttcgccggcaagcagctggaggatggccgcacccttgcagactacaacatccagaaggagagcaccctccacctggtgctccgtcttcgtggtggtcagtaagccatcagtcgttcaagctgctgctgtacctgggtcgtctagtgccttttgtttctgccatggatgttactatctttgaagtatttgtatggtctgtgtcgtgactgagtttgtttcttggaccggttgtgttcctctgtgttctacccaaaactattgtgcggcagcagcctaatcatgaataaaagtgatttaaaatatgtgctgaatat

SEQ ID NO: 202 - DNA, 759 bp, Saccharum
cggcagcctggacagatggctccatggcgattatgtcctccgtgcaaggcaccctatggcgagggtgcggcctgtgcagcgtgtgccgttggactggccaacgaggctcatagtagctgtcggtgcagcgcaggggctgtgctacatgcaccacgagtgctcaccgcccatcattcatcgggatgtcaagacgagcaatatcctgctggattcggagttccgggctaaggtcgcggactttgggctggctaggatgttggcgtgggcaggggaacccaacacgatgtctgccgtcgcgggatcatttggctacatggctcctgagtatgcttacacgaggaagataactgagaaggtggatgtcttcggctttggtgtcgtgctcctggagctcacaaccggcaagaaggcaaacgatggtggtgagcagggggggctctctggcagaatgggcagggcaccactaccgatcaggggcgagcatccctaatgctacggatgtctgcattagatatgcagggtacactgatgagattgagacggtgttcaggctaggtgtgcaatgcacgtccaactcgccgtcgtcacgtccaactatgaaggagatgctgcagattctgctcaaatgcagtgagcagacgctccggaaaagcagactggagtgtagcatggagttagatgcagctccattcttgctcccataacgagccacctctttatatatttgcattcactttcctttcattttcgaaccttttt

SEQ ID NO: 203 - DNA, 731 bp, Saccharum
cctgcaaccattggttttactccaaggcattgtcttctctgtgctcaccactcgccattcgtaacaccacccctactcccctcactccaccaaaccccccgcaccaaccaccccaccccacacacaacttgccagcataaagagaggtgccaaggcaaagctagaagaagacaacacaaagggagaggagcagaggacgatggccggcggcggtgctaacattgtccccctcgtcaccccctacaagatgggaaaatttgatctttcccacagggtagttctcgcaccactgacgagacagcggtcgtacggcaatgttcctcaacgtcatgccatactgtattatcaacagagagcgactaaaggaggtcttctaattgctgaggccacgggagtgtcgggcactgctcaagggtacaaagacactcctggcatttggaccaatgagcaagtcgaagcatggaagccaatcgtagatggggttcatcagaaaggagggatatttttctgtcagatttggcacgtagggagagtctctaattccagttttcagcctaatgggcaggctccaatttcaagcactgataggccactaaaacctcaagtgagagccaatggtgtagatgtggctactttcacaccttctagacgcttagagactgatgaaatccctttggtcatcaatgatttcagggtagctgctagaaatgcaattgaagctgggtttgatg

SEQ ID NO: 204 - DNA, 1132 bp, Saccharum
accaaagattcttcgatatcgatagatatagataaataaatagaaaaacgaaccatgacattacacactatatcttcagctgagttcatcaatgccttaaaggaaatcacattactctaaccattcaagggaaacacacaaaagatgggcctgcctcacaaggccgacgaatgtttattacagccaccacactcttctggttctcattggtcttaggtgcaaatagccagcaagatagatcagctaggcaacaatcttcatccacccctgccccgccccgtcccgtcccgtccccttctttatgggcacctcaccttacgcctcagcaaatcccaattcagaaagcttcaggtgggcctcggcgtagtcagcaaagaaagcgtcctcatccgctgcatatttgtcaacaagtgggcggaaggatggatcagagaggagggctttgtcacttggtagctgcagaaggccttccttctctccactcagaagctccgtgaagtaagagttgtcaaagattaaagggttggatgtccaggctccctcaaacccagacctatccttgtggcatcttcccagggtgtgaccaccagaaagtgcaacaatgtcctggtcgctcaaacccatctgcgtcgagaaaacctgcctgaggtgatcagagccttgggtggcatcaggaaggcggccttctggcggaggctcaggcttgtcctgccttccagggtggaaggggacatcaggtccaccggttacctcaactgccacgactccggcaagctggtagaagtcagcgtaggataggatagggaactgctccttgatgggctctagcagcctgacggcaatttccagtccggcgttggctccgtgcgcctgctcggcggggttcttcatggtgccgaaggggcccccggtgttggtggccacatcgaaggtgcccgcggagtgccaggcgaggcggagcatgagcggagcgcagttcttctcggcgatgaggccgcgaagcttgcgcttggccttgtccaccgccttgaggtagtcctcgctcaccgtggggtaggccttcaccatggctgctgactactggcccggtggtccgatcggagacggagaatgggcggcagcaggcgcagcg

SEQ ID NO: 205 - DNA, 1165 bp, Saccharum
tttttatttctttcggcttgtcttgttttggcccaaacaacaggggacaacaatggcccggtccataattttcagccgtcccagcacctaaagattggttggtttcatccattcatcacacagtctagctagctagtaatcctccgaaactctggtgatcctggccaagcaattgtccaccggcctcggatggggcaggtacctcacccggcacttagggttcgtcctcgtcaacttgtagccgaggaggaactggtggaggaaaacggatatctcgaccttggagaggtcgtccccggggcaaatcagagtgccaagccgtaacccaaggaacgtgccgggcctcggcaagtggccctcccacctggacgggttgaacttggtggggtcagggtacacctgtgggtccatgtgcacgctccggtaccatagctgcaccttccaccccttggggatcaggtacccgttcacgaagacatctttggtggcctgacggaaggacacgaaggagatgttgacgagccgcagcgtctcatcgatcacctgcgagaggtactccatcttcctgaagtccctgagcgtcagcccctgctgcgacgccgggatgctcctcatgatcgcctcctgctccgcctttgcctttgcgaagatgtccgggttctcctgcaggaacacggtggcccacatggtgatgtggccggacgactcgtgcccggcgttgaggtacatgatgagcacgtcgatgatctcgtcgtcctccagccgccgcccgcgctcgtccgccgcctcgatcagccggtccatcatgtccacgccggaacccgacaccacaacccccttggccttggcggcgcgccgctcgtccaacacgccctgcagcacggccacgagccgccggcgcgcgcgcagcgccctgcggtacgcgaacccaggcaggttgatggccatggcgcgcatcccgtagttgaggtccgtgtagctccgctccagcgcgcgcgtcgtgggctcgtccgcgccgcccaggaagatctgcacgatgatcttgaacgtcatccgccgcagctccgtcaggaactcgacccccctcccggcgccggacgacgattcgtcggcccacgcgcgcagcgacgacgtcacggtgcggtcgatgaagggcaggtacgcg

SEQ ID NO: 206 - DNA, 783 bp, Saccharum
gcccacgcgtccgccaaaggccaccaccattccttccccaactccgcaggctgctcaccgccctccctccgcgccggacgcgcctcgatccagatccaggggcttatcatggcatcaaaacgtatcctcaaggaattaaaggacctgcaaaaggaccctccaacatcatgcagcgcaggtcctgctggtgaggatatgttccactggcaggcaaccatcatgggtcctcctgatagtccatatgctggaggtgttttcttagtgaacattcatttccccccggactaccccttcaagcctccaaaggtatcttttaagacgaaggtcttccatccaaacatcaatagtaatggaagcatatgtcttgacattcttaaagagcagtggagccctgctttgacaatctctaaggttttgctttctatctgctccctgcttactgatcccaacccagacgaccctcttgtccctgagattgcacacatgtacaagacggatcggccgaagtatgaggcgacagcccgcagctggacccagaagtatgccatgggatgaaatgaaatgaagccgaaaccccatattcaggcattactgcttaaatgcagacgattgtggtgttgccccatgaaactgtttctggggacgtatgttcttccattccttgtggtcgtgtgcattctctgatccatctaggatcgagtcctagtccaacatcaacctaccattgccgtcgataatgagatgacttatgcttgctgtgataactatgctagtgttgatgtt

SEQ ID NO: 207 - DNA, 1677 bp, Saccharum
caagcctcaaaatcccactagcgaaagaaaaacgagagaagcagcagcagccgcggctccatttcttcttccttgagcactcgcctttgcctgctcaaagagcttgctttggtggcatcggttcttcgtttcatggccgagatctgctgcgaggtggcggcggccgggtcggaccggaaggggaagtgcgtcggcgcggacgccggcagccgcgcggcgcggcggcggaggatggagatccggcggctcagggtggtggccgaggaggcgtccgccaagaggccgaggctggaggcggatgtggaagacgcggttaggggaccggcgccgaggtacggcgtgacgtcggtgtgcgggcggcggagggacatggaggacgcggtgaccgcccgccttgggttcatcaacggccaccacttcttcggggtgttcgacggccacggctgctcacatgtggcgacgtcgtgcgggcagcggatgcaccagatcgtggccgaggaggcgaccgctgccgccggctcgtcggtttcggacgacgcggcgcggtggagggatgtcatggagaagagctattcgaggatggacgccgaggccgtcggctccagggagaccgccggcccggcgcccacctgccgttgcgagatgcagcttcccaagtgcgaccacgtgggctccacggccgtcgtcgccgtggtggggccacgccacctcgtcgtcgctaactgcggcgactcccgcgcggtcctctgcagcggaggcgccgcgatccctctctcagatgaccacaagcctgaccgccccgacgagctggaacggatccacgcagcgggagggcgcgtcatctactgggacggcgcccgcgtcttcggcatgctcgccatgtcccgcgccatcggtgacagctacctgaagccgttcgtgatatcggacccggaggtgcgggtggtggagaggaaggacggcgaggacgagttcctgatcctggccagcgacgggctgtgggacgtggtgagcaacgaggtggcgtgcaaggtcgtgcgcacctgcctccgcaacagagcgccgcacccgcacggcggggagcggtcgagcccgacctccaacctgagccccaggcagagcagcggcagcggcaacagcagcagcagcggggacgaggaggctgcgcccagcgacggcgcggggtccgagagcgacgacggcgagagcagcgaggacagggcgtgcgccgaggcggccatcctgctgaccaagctggcgctggcgcggcagagcgcggacaacgtcagcgtcgtcgtcgtcaacctcaggcggcgcccgagatcgtgatcggcggatccaacggactagccgttcctgatgtcctggccggccggaaattcaaatcggagcccagttcacattcgcttcggccgagcaatcattgaacaaaatgtcaaagcaaagatcgaacaaaacagtgagatatacagtagtatagtacagcaggattaattcattagcatttttttggtggggcgtttctgatctggtcggacagattagccctgcctttcttcttccccgagcaaattctccaaatagaaaagaaaagcagagactttccgatgtttgaagaaacttaagcgtccgagaaattaattaattgtaatatagtccagtgcccctttcagtaaa

SEQ ID NO: 208 - DNA, 828 bp, Saccharum
gcaccaggagagagagagagagagagagagagagagctgtgcacgaagccgacgagcagccgccgcgctaaagcttggtccggggagcttcggaggagggcggggtaggtcaagatgcagatcttcgtgaagaccctgacggggaagaccatcaccctcgaggtcgagagcagcgacaccatcgacaatgtcaaggccaagatccaggacaaggaaggcatcccgccggaccagcagcgtctaatcttcgccgggaagcagctcgaagacggccgcaccctggccgactacaacatccagaaggagtccaccctccacctcgtcctccgcctccgcggtggcatcattgaaccttctctccaggcgctcgcccgcaagtacaaccaggacaagatgatctgccgcaagtgctatgcgcgcctgcaccccagggctgttaactgccgcaagaagaagtgtggccacagcaaccagctgagggcaaagaagaagatcaagaactgaaacttggcaaatcggttccgtgtgtcgtttgggtcaacaagatggctagaagtttcaaagcttttgttgctgcataatgctgctgctgcttttctaagtcagaactttgtggtgttcctgttcagggtcttcagcatgtatgtgctggcataaatcgtgacagaagtctgggttattattactatatggtagcataactctattgtggttttccctttctgttgctgttgtgttgtgctgccgccagccgtagacggaaacgttcagggccagtttggtttgttaaagtttaataaatactgtagcactttcgtcttttttgac

SEQ ID NO: 209 - DNA, 1757 bp, Saccharum
cctgcctttccctcgacgctcgcggcaagatccacatgcagtagtaggagaagtagtagcaagcaagagtagccttgtttgggttggttgttgctgcgagcttcattcgatcggctttcaatcaaatcaggaacaacgacagatccgaggctttctcgaatcgggcaggtccatcaaatcgcaagtttagccagcccagccacaggcagctagctatcaaatcaaaggggaccaaaaggatatctctggctcctgcccctcctctcctagtcgtataaaattcccctttcgagactccccccagcctccttcctcctccgatctctcaccacgcgcgctcttctgctacctttgctttccctgcgatccgttccttgccctagctagccggatcgagcaagaaggcgaatcctcgacgactcctagctcgttcgtcggatcgatcgatctcgacgacagcgtcagcgcctcaggtggaggtggtgggagctgctaccagctagctgccacatttcggtcatacttcgagatcatatcatgatgtcgtcctcgtcctcgtcgtcggccgccttcccgctggaccacctcgcgccgtcccccaccgagcagctctgctacgtgcactgcaactgctgcgacaccatcctcgccgtcggcgtgccttgcagcagcctgttcaagacggtgacggtgcgctgcggccactgcgccaacctactctccgtcaacctccgcggcctcctgctcccgcccgccgcgccgccggccaaccatctcaacttcggtcactccttgctctcgcccacatccccgcatggcctcttggacgagttggcgctccaggcgccgagcctcctgatggagcaggcgagcgccaacctgagcagcaccatgacgggccgcagcaacagcagctgtgccagcaacctgccggccgcgccgatgccggcagccaagcctgtgcagcaggagcccgaactgcccaagaccaccgccccgtcggtgaacaggcctccggagaagaggcagagagtcccgtcggcatacaaccggttcatcaaggacgagatccagcgcatcaaggccggcaacccggacatcacacaccgggaggcgttcagcgcagccgcaaagaattgggcccatttcccacacatccacttcggcctcatgccggaccagggcctcaagaagaccttcaagactcaggatggcgctgaagacatacttctcaaagatggtctctacgccgcggcggcggctgcagcagccaacatgggcatcactccattctagctggttaggcaggcatgttctgaatctggcacgcagtggctatcgcccttgtgctgcattctagggtttcgtctcagatcttgatctcagtatggcgtgtcgttaactagagtaatgtgggggtagaaatggagaatcaagttagagcacctactaggccactgatgatcctataggtacagacttgattgtctcctctatttcaatccctttcatttcatgttctctctctttttttatttttttgttcctggacctcttcaattcgcctgtagagaagtcgttgtgcctcctccaatcccatgtttgagtctgttcaagaacatgtttttaccatggagaactagttcggcatctggtaaatctggcaacagtgccatatatatgttccttcctccttttccatgtactactactatgggtgtgtttagatggttgtaaagtgtgtgtaaagttcctgt

SEQ ID NO: 210 - DNA, 2448 bp, Saccharum
agcagagtgcctttgtgagtaaatttcttgataattcaggtgctgaagacacagggccttatcccccacgacaagatttaaatcagtatccttttggttctacgtatgacaaatacatgacacagctttcgtcatgttcaacagatacacaacctcacatcttttctacacgatgtgtcaattcatctgaaagggccaatacaaccgttccattgatgaatgacactattggggaaagttcattctccttttcgccttatatgaatccttgcagaatcaatcttgattattttgattgtgtgtggaatgaacaaaaaggtcttggataccaaactactgataagcagcatggaaaatggagtaaccctgatgacaaggcaacagtggggaactattccctcagttctcctggagagaaccaccttaatcctgagcatttagggaatgggagaccaacgcagggatcttctgaaatgaaacatgatttgggaagtttcagttccaaggtttcttcgtctgagtctggatttgttcagcctcgtgaatgttcatctgagtttcctgaggtcaataacaccagtgttgattcaccttgttggaagggcacaccagcctcataccagccttcgtttgggatcatggaaaataatggtgctcctcctgtggtgataggaacagtaggctacatgaattcacatcaaaaccagaagctccctgagttgaattccgagtatccatggcgattctgtgaacaccatgaagcatcgggttctgagaatgacccttttaaggcgttcaagttgcctgaaagatgtaaaatctccaaagatcataaagaagttccgccaattgatgtcagggttcttaaggacatgactactcatgctagttatttgcctgacaaacagcattccacgacacataaatgctatgattctgaagattctaagaatgtgataacttcaagtcaacaggaaagtttgtgtcctgccagcaaaccaaaacttttgggtgaacatggtggcagccttacagcaagcatagatgagctactgagtaaaagtgtgataaatcctattgctattactcctagagttcatacagatcatttaagaacaggaagcccacatggaaatattttttctgcagttgtggagaaagaagaaagcactcaaaaaagaggtgaagacccttctcaatgttatcccggtgttgaggggaatatgctgaatatgtcttccgaatccagctctagcactcgggcaatatttctgaaactaatgcacaatctgtcagtagtgcttctatcgacctgcaagggcggttcttcgttgcaggaagatgaagaggagcttctgcaatcagcgattcaaaatcttacagctgccagttccaaaagaagcaaggttgaacaaaaaattgatgatggattgagcaactcgagtcaaatgaaattaaaaaatattgattgtgcgaggaacaacttttggaggtcaatgcatgaagattcagcacaggagaatgctgattcagaattgaaggccactgtttcacaggttcttactaatcacctggaggataagatgcttcacaacactgaagtttctcaggcgtcaatctatagaaacttgtggattgaagcagaagcttcagcttgtaaactcaaatatgagcttcaacatgctcgcctgaagctcgagacagcaaaaggcctcaacgacacagtaaaagccaactcattggaaggcagtaaaggctctaactcatacatgtccagtagcaaaccacagaaccatgggaaagaaaccattacatgcgctgcggcttgtcagggccagggaggagatgctcgtgacaagcaatctcctgttgtaaataggagcattttcaatggtgttgatgctgatgtgtttgcccgatttaaggttttgcagtcccgtaatgataatgtaaactccttcagtgagattgactgtggggagcagcaagaagcaagcaagagaccatatgcagtcgaagatgctgttatggcgagactgaaagttttgaagtctcgtcctgacaatataacctctttgagtcaggaaaacaacaaacagcagctagatgcaagcacaaacagtgcagataatgttgatgatgctgttatggctaggctgggaattttggagtcccatcctaatagtgcagccctattgggacaggaaagcagcaagcaacaactggatgcgagaacaaatagagaagatggaattgacgatgctgttatggctaggctgagaattttgaagtctcgacctgataatgaaacctcaatgggtgatgccaacaaggagcagcaagacgcatgtagtgatcaattaaatggggacgaccttgatgttgtttccaatggaacattaagcacaccctgagtgagaaatgctctaagttactcactctgatgat

SEQ ID NO: 211 - DNA, 1201 bp, Saccharum
gaaacggtatggtaactttaatccactagccactaatcattatcctttcaactaacatcacagcagaaatgaaactaccatgatgctacaccctacttaaaatcacctgtttcagtttgatacccaacgatattagctaacgaaaacctgcagtttggacaacctaaaatgagaactctgaatcaggtgatagcttctgagcaacattctcagccactttcatgcagagactgctgctcttcaggagcttgcccctgctgttcctgaggctcctgccacaaatacgtcactgggtggctttgctgggcaccataaaccattccaggaccaggcacctgctgctgttgcatgtagtagtatggatatgcatcagctggggctcccatgggtggcaacccagccctaggaagcccaaccccgtcctccttcatctcatccctgggaacaatgtcgaccaagaagtcgtaaatgtcagtcctagtgatggctgctgcaatgtcattcttctgcaaggtgcggcgcttgttctcctcagtgtgcatccacgacctcagtgtcaactccagtatgaatatctcacaagcttttgcaaagaccacaggagcttcagccgagatcatgcgaacgtcttcatcagccttcatgatcttctttatcctcgcaagtggcaagttgtggttcttgaaatcagtggtcgcctcaatttcagccatgcgttcagcccagaactgctgaagctgctgctgttgctgctgctggagctgttgatggaattgttgagcttgttggtagacaatctggtgctgagaactcatatgagcagggttggctgggaatggttgcactgactgtaaaccagcagatgcaactgcaggagcagctactgttgctgcaggcggataggcagaggcaggatacacttgcgatccagcagcagcaacacccattgcaggctgaggctgagaggatggttccatgtccactcgctcttgcccaaaaatctaagatctttccagaattggaagttgcagcagcagaaggtcggccgacgggcgagacggcgggacgacgcctccttcctcgcggctggctcggctagggcagggattggagaatggggagaggaagcctgctggcctcccttctctctctgtctcctcgacttccccctctgccctctctctcctgtctcctctggtcc

SEQ ID NO: 212 - DNA, 2030 bp, Saccharum
  misc_feature 1995: n = A,T,C or G
aacccttctctcctccccgaccctcgagccccgaaggacgcagagtgtccagaagcatccccaacccagcccgcggcgatcgcgcggaagctggcggcttgcgacgcgggagagggagaggcggcgagggttagctggagatggacgcggcggagaagctgcggtggcccttctcggacggcagcgtcaccgatctcctggacgcccgcagcctccacggctcccccgacattaagaaaaaagtacagttccattcttctctagtgcaaaagcttgctttggaaaaggagatggagggtcacgcaggttgcgtgaatgctattgcatggaactcaagtggctcgcttcttgtatcaggatcagatgacactagaattaacatctggaattataataaccgagagctggtgcatgatattgacactggccattctgcaaatatcttttgcacaaagtttgtcccggaaacatgtgatgaagtagtagtctctggagcaggagatgcagaggttcgtgttttcaatatgtctcgattaagtggcagaaggcctaaagaaatttctatggaaccaacagcggtttaccagtgtcactcgagaagggtcaagaaactagctgttgaagttggcaatcctaacgtagtgtggagtgcaagcgaggatggtactctgagacaacatgattttcgggagtgtagttcctgtcctcgtgcaggatctgctaaccaggaatggcgtaatgtgcttcttgatctacggtgtggagcaaagaagtctttagctgatctacccaaacatccattggcactgaagtcttgtgacattagctctgtttgttcccatcaaatccttgttggcgggagcgatgcatttgctaggctgtacgataggagaatgcttccaccattgagctcgtgtcaaaccaaaagaaagccgccaccatgcgttaaaatgttctgcccattgcatcttgctgacagtaagaagacatatttgcaccttacacatgttgcattcagcccaaatgggaaggaggttcttttaagttacagtggtgaacatgtttatctgttcgatgttgacccagataatatgagttcagttagatacacagcagactatgtacgggagcaattatctgtacccccttttcacaaagtaccagcaaaagaacatgcaaaagaaaagaaggcttcagtaaatacaacttcaagaaatttgtctagggtagatatgtgcaagaaatttatgcaagtcgcaaccagatctctggagacaggcaagaacttaatgcgtgggattgaagcatgcagtgaagttcttgaatcaataaaacctgatattgatgatgacatgaggcatgagtttttgtgtactcgagcagcattgtacctaaagaggaagtggaaaaatgatgtttacatggcgattcgagattgcaatagagcgcggaagattgatgccacatcatatcaggcacacttacatatggctgaggcattgttgcagttaggaagactgaaggaggcatctgagtatgcagaggcggcaaatagtcttcttccacctcattgtcaattgagggagcaggtggatgatttcaagcaacgcgtagcttcagctgagcttgagaagaacagaacggatcaaaatgggaactccaaagctgatactcatggaaaattacgctcattgagtgaaatattatttagacccgatgttggtggttcctcacaggagggacgagaagattcagattatgatgatgaaatggaattggactacgagacatcggtatctggtgatgaaagccgagagaatgatcaaggtgtcttccggggtagtttaagtttccgatttcatcaaagagaggatcaaaccaatgaacacactgatgaaaatggatcaatcgagtctgctcaaaacgacaattctgcttttcagtcagatgttgccattgatatgaaacaaagatatgttgcacactgcaatgtanggacagatataaaacaagccagctttcttggtgag

SEQ ID NO: 213 - DNA, 1108 bp, Saccharum
cctctttttcctcgcactccgcaagaccacctcgtcctcaccagcctcctcgtccccgatctcctcccacccgcatccaagggtttcggtctctaccgccgcggaacgagccagcgaacagggatggcggcggcgcggcacctcagatccggtctccccctcctccgcgcccacctcgcatcctccgaatccacggccgtcgcccaggtttcgaggggcttcgcgtcgcagccggccaagcccaccgggaaggagatcaaggttccagaagctctgtatggtggcacaggcaactatgccagtgcactgttcctcacagcagctaaagctaactcattggacaaagttgagtctgagattaaaactgttgtagaggcatccaagaagagtccgttgttttctcaattcataaaggacttgtcagttccaaaagagaccagggtgaaggctgtaaccgaaatatttgctgacgctgggttttcagatgttacaaagaatttcttggctgtcctggcggacaatggcaggctgaaatatattgagcgcattgctgagagatttgttgatttgactatggcacataagggggaggtgaaggttgtggtcaggacagttattccacttcccgagaaggaggagaaagaactcaaggataccttgcaggatatccttgggaaaaacaaaactattttggttgaacagaagattgactacagcatcatgggaggattagtgattgaattcgggcagaaggtgtttgatatgtctatcaggactagggcgaagcaaatggaggcgttcttgaggcaaccccttgaattctaacagccttttggataaaaacatcatcagaatgcagaggctgtgctgttgaaggtttccccatgtctgcaactttgatctggcctttgaataaaatgtttcctctaacaagtgaagggcaccgttttattgtcttgtgggctagacgcctgctgaacagtttatgttcatttctttacttaaagaagcatgcaccaaaaacatgaaggatgcacgccatggaaagtttttgagctctcattggaacgtatgaacttctcacgcaatgcatcatttttttttttgt

SEQ ID NO: 214 - DNA, 1212 bp, Saccharum
agaattcagatccctcccaccacatccgttctctcccctagtccccttcccctccctcctcgcgcgcgcccccggctcgcgcgcgccgccggctctgcccagatccaggaggtatgcctcgctatgatgaccgctatggaggcacgcgcttgtatgttggcagattggcccctcgtactcgttcccgcgatttagaaaatctgttcggcagatatggaagaatacgagaagtggagttgaagcgcgactatgcatttattgagttcagtgatcatcgtgatgctgatgaggctcgataccaactagatggcagggatgttgatgggagtcgcattgttgttgagtttgccaaaggggtcccacgtggtccaggtggctcacgtgaatatatgggaagaggccctccaccaggtacaggtcgttgtttcaactgtggaattgatggtcactgggcaagagactgtaaggctggtgactggaaaaacaaatgctaccgttgtggagaaagagggcatatagaaagaaattgccagaacagtcctaggagtgtcaggcgtgaaagaagttactcacggtccccaactccacgccgtggaaggggtcgcagtccaagctatagcagaagcaggagcaggagctatagccgatcgagatccctgtctggatctcctaggggaggtcgccgtgaccgtgacgataggagatcaaggagccttagctacagcaggagtcccatgcgatctgcctcgccacctccaaaggaaagggagcgcagccccacacctgatggaagcaggagcccaaggagtcgcagcccccaggatcaggtgatgagcccaccaccaaaggataatgacgaaggtaatggttcagaccgtggcgacagccccagagggagggaaaacagcaggagcaggagccgcagccgcagccgcagccggagcccatccggtggtaaccgcagccctgcagctaatgggcgtagcccgagtcctagaggtgaccgtagtccaagccccagggttgaccgtagcccaagccccaagggcagtggtaacaacgacgatgctgatgctgcccccggtggttcccctgcaggaagcaagtccccttgaagtttgaacgctgcccctccccatttgtggtgcttcgtgatgcaatgggcagactctatggtcatagctatttttactaccatatatcaaagacatg

SEQ ID NO: 215 - DNA, 771 bp, Saccharum
cggacgcgtgggcgctccgagagcccttcttcctcctccgtccccgatccactgcccgcttcccgctccgatcgatctgatccctccccaccaccgcgcccatggcggaccagctcactgacgaccagatcgctgagtttaaggaggccttcagcctcttcgacaaggacggggatggttgcatcacgaccaaggagctgggaactgtcatgcgctcactggggcaaaaccctacagaggctgagctccaggacatgatcaacgaggtcgatgctgatggcaacggcaccattgactttccagagtttctcaaccttatggctcgcaagatgaaggacacggactctgaggaagagctcaaggaggccttccgtgtgtttgacaaggatcagaatggcttcatctccgctgccgagctccgccatgtcatgacaaatcttggtgagaagctaactgatgaggaggtggatgagatgattcgtgaggctgatgtggatggtgatggtcagatcaactatgaggagtttgtcaaggtcatgatggccaagtgaaccacagaaccataaaatctgaaggcggagaagattgggcattgcatattagtcaagatgcaactcttatttcatcgacttccagtgaaacattctgctagttgtagttgctgaaatgcaatgtagttcctgctttgttcttcccttcagtgtgttttcagaaatgttgtttcatgtgaacctgtaatgattgctgtgtcttgattgcagttgaaaccat

SEQ ID NO: 216 - DNA, 509 bp, Saccharum
cggaggatcaagatggcccttgatgtggccaaaggcatgaattgcctgcacactagtgtacctacaattgttcatcgagatctgaaatctccaaacttgctggttgacaataattggaatgtaaaggtctgcgactttggactttcacggttgaagcacagtacatttttgtcatccaaatccactgctggaacacctgagtggatggcacctgaggttctgcgaaatgaacaatcgaatgaaaagtgcgacgtttacagctttggtgtcatcttgtgggagctggcaacacttagaatgccatggagtgggatgaatccaatgcaagttgtgggggcagttggtttccaggatagacggcttgatattcccaaggaagttgatcctctggtagcaaggatcatatttgaatgctggcagaaggatccaaatttgcgcccgtcattttcacagttaacaagtgccctgaagactgttcaaagactagttggaaaaccccccccccccct

SEQ ID NO: 217 - DNA, 1204 bp, Saccharum
atgaactggatgaggatgagcaagatgaggaagattccgacgaggatgatcccaaatttcagcaggacactgcctgtgagtataggaaactgatcaccatccaagctggcaaaccaaaaggccatttgcgggatgcactaaaggtggatccagaaaaagtcaggcggctttcgttgagtgagacacagttagctaaagcgacaacttctcatggtgctgaagtcataaggttcacccagaacaatatactccgtgtgtatccaaagggcacgagggttagttcttcgaactatgatccaatggatgcctggactcatggtgctcagatggttgcattcaacatgcaggggcatgataaagcactccggctgatgcaaggatttttcatagccaatgggggctgtgggtatgttaaaaaacctgacttcttgctaacgactggtccaaagggggaagtattcaaccccaaaagtagtttgccagtgaagaaaactctcaaggtaaaagtatatatgggagatggatggcgcatggatttcagcaagactcatttcgatgccttttcacctccagatttctatacaaggatagggatcgcgggagtaagggcggacactgtgatgaagaagacaagggtgatcgaagaccagtgggtgccagtgtgggacgaggagttcacgttccctctgagggtgccggagctggcccttctgaggatagaggtgcaggagtatgacatgtcggagaagcacgactttggggggcagacgtgcctgccggtgtgggagctgaagcagggcatccgtgctgtgcccctgcacgatcgcaagggcaacaggtacaagtctgtcaggctcctcatgcgcttcgattttgtctagctagtgtcgacctgcacaaaaaacattcagattcagtcagtcggccattcagtcagacagagtgttcttcttcttttacatctacttgtgtgagtgtgtttattacagggaaatcaagctagtactatgtagtatgagttagcagtagtgtgtgtgtatgtatgtatggtatagactagagtgcacccattatattcctgccttacgcccatcttcaattcttgcgtgcatcaatcaatgtgtatgtatctgatttggtcttgtctgaataaaaagctgtatggaaagaaggaggagcaaggcctccgaaatacttttcagcg

SEQ ID NO: 218 - DNA, 1453 bp, Saccharum
aacatcaagaaagttattctattccaattccaagctgcaagtcatgtattacttcttgccttggtatcattcgaaagaacacatggttgcaaattacaggcagcagctagaggcatccgtagaatgcatataggttcaacattcgttaaaacttgcaccacaggccacagcgaagtcagtttttaacgactatttcaggaccaggggaagaaaagcaacaagatttacaaaggagtctttcttactgaaaaaataaacaagcgaaaattacacaactcaaaaagaattgtaaaggaaatttagagcacaaatcgcagagaaggcaacaacgatgctatggcctgtgggtaaaatagccaccgtaccaacaaaacacagaaaaaaaaagaagtttattccaatgaaaagcaaagacattctcaatgcacaccagaataatgagtaacctattgctgcaccaccttccaaacacgaatgcaagcatcctcgccagcagtcaccagagtatcattctccaggaaggttaaaccatgaactccaccaagatgggctcccttgatagtgacgcgactggctgctggcttgtctatctcgtagacaattgcacaggtgtccagtgagccagtggcaaccaatcgactgtcaggtgaccaagccagggagtttatcctagctgtgtggtacaacatgttcttcagcttgacctctctacttgcccgatcccacacaacagcttccctgttggcatcagcagaagcaaacatagaaacatctggcgaataatgtatggaagtgatagcgccccggtgcttctcaagcagagcttcttctgtaagcgtattgccagtgatggaatagattcgcagtttcccatcttgagcacccacaacagcttccgtgccatcaggagataccgaagatgaagtgatggtatagttaactttggttgtagaaatgacttttgagttgtgcagtaatacaatcccagaatcagtagtgatcagtgcaaattcaggtttttgaattgcaaggttcaaagcatttggctgaccacctacatcaactgactcagcatctccacactggtctccattaagaggaattctgaagaccttattatcataacctgaggtaacaagctcttcttctactgcagcaaagcattttatttgagtgttgtttttgcgcgtcaatctgccaccaaatccaacaccctgtatccacctcatgatgacaccatcatagctagtagatagtatagttcttgggctacttttaggaaagaagaccaaagaactaacagtcttcaaatgtcctgcaaatgtaactggttcttggtctgggttgcttgcagagaacacattaaatgtcccaccaagagagactgtcacgagatggtcattctgccagagacaaccaacaagcatatcatccacacctcccggacgcgtgg

SEQ ID NO: 219 - DNA, 576 bp, Saccharum
aatgatcataacaatgctgcttcattaacaacacaatgaggtgcagaccagctgcatcgtcgtcctctcattgcttgcatccaacaaattcaagccttgcagacctcaacaaccgtccataggagtactgaagtgcatgtaacagagggcatcattttgtggaggaagcagacatggcttgggcagcagcacagacatggagaacctgtcaaagaaaattgagaacgggaagtgctaggcactagcctttggcttgagtttttgaaaaatgattctcacataacctaatggatgtgctctagttttggaagtgttgggtaagtctttggctttctggaaggtgtttctccacataacttggtggatgtgctctagtgttggcaagccattgcttttggtttttgagttcctaaaaatgattgtgtgcacaaaccttagtatgtttaacacaatattagtattgcttgcagggagtgcattcatgtaatcttttggtgcctgactttggatgattcaaacagtgtgcaagacaagattgtatgttatatgtattgacctccatgatgtgatgtacat

SEQ ID NO: 220 - DNA, 900 bp, Saccharum
ctagctggctcgctatagtccatacgtagatcgaagacaagtagctagtatccatgacgtccaggcgggcatccccctctgcagtcctgttgctcttgctcgctgcctttgcggctagtgcaagagcggcgacattcaccatcaccaacaactgcggctcgacggtgtggccggcggccacgccggtgggcggcggcacgcagctggacccggggcagacgtggacggtggacgtgccggcgggcacccagtccggcagggtgtggggccgcacggggtgctccttcaacggcggcagcgggagctgccagacgggtgactgcggcggcgcgctgtcgtgcacgctgtccgggcagcctcccatgacgctggccgagttcaccatcggcggcagccaggacttctacgacatctcggtgatcgacggctacaacctgcccatgctcttctcctgcagcaccggcgtgacgctcaactgcggcgggtctagctgccccgacgcctacctgtttcccgccgacaacacgaagacacatgcatgcaacggtaacagcaactaccaggtcaccttctgcccatgatcaccgaccgatcatgaggctgcggccagcacgcatcgtactactatgagatacatacttcttttcctatatacgctatacgtatgtctgtccgatcctagctagtggagattggagaatgaataaaagtagatgaataagacggtgtcgagaaaagtcgtccacacgcgtgcattgatgttcacgcatatgtaacttcgatttatactttcaaaacatgggttatgtttgtgtcttatcagtcaagtagttgtattcgttaaaccgtatgcatgacatttatatatggtgatctttgtgctttagccttttttgttgt

SEQ ID NO: 221 - DNA, 1477 bp, Saccharum
atcagagctaattgaaggacttcaaaatgttgaaactcctgaatcgccaaaaccagacaatgttgatagccaatcaagtgttgaaacaaaaagctcatccggggaagttaagaagcctgagtctgtagctattcctgaagatttccgttgcccaatatctctcgagctgatgagagatccagtaattgtttcaacgggacagacctatgagcgtgctttcattcaaaggtggattgactgtggaaaccggacctgcccaaaaactcagcagaagctccagaatcttgcattgaccccaaactatgtgcttagaagtttaatattgcagtggtgcgaggaaaaggggatcgaaccacctagcagatctaaaagtgatggttctccccttgaggttggtggcaacagattagcaattgaagcattagttcgcaacctttctagcagttcattagatgaacggaaatctgctgcagccgaaataagatctttggccaagaaaagtacagataaccgtatacttctagcagaatctagtgctataccggctctagtgaaacttatgtcatcgaaggacctgaaaacccaagaacatgcagttacagctcttctgaacctctccatatatgatcagaacaaggaactgatagtggttgctggtgccattgtcccaatcatacaagtgctcaggatgggtagcatggaagcaagagaaaatgcagctgcagctattttcagtttgtcactaatcgacgataacaagataatgataggaagcacccctggggctattgaagcattggttgagttgttgcagagtggtagctcaaggggtaaaaaggatgcagcaacagcactgttcaatctttgcatataccaagctaacaaggtcagggctgttcgagcagggattctggtgccacttattcggatgctgcaggattcatccagaaatggggctatcgatgaagcactgacaatcttgtcagttcttgtgagccatcatgagtgtaaaactgctatatccaaggctcacgctatacccttcttgatagatttgctacggtcaggccaggcccgtaacaaggagaatgctgctgctattttacttgcactttgcaagaaagacgctgagaacctcgcctgtatagggaggctgggtgctcagataccactaactgagctggcgaagaccggcacagaccgagctaagcgcaaggcaacgtcactcctggagcatctcagtaagttgcaggtgctctaatcccaccgtccaccgcacaccattttgtgcgtgcgcgtgtgttttcaactctttcacgtgtatgtatacatacgggagaattgtaacatcatctgtcagtgagtgtgaatttagtgggttggtgattagtttgtttcagtcaggaccaaacgcttgttcatcgaatcacgccataaattggttggtgccccctgaatctgagatgttctgttgctc

SEQ ID NO: 222 - DNA, 456 bp, Saccharum
gcctgcctgctctaacaggacagcagcagcctacctcgccagctctgcggcaatggagcaggagctgcaccggcccatggagctgcccccgggcttccgcttccacccgacggacgaggagctcatcacgcactacctcgcccgcaaggtcgccgacgcccgcttcgccgcgctcgccgtcggcgaggccgacctcaacaagtgcgagccctgggacctgccatcgctggcgacgatgggggagaaggagtggtacttcttctgcctcaaggaccgcaagtacccgacggggctgaggacgaacagggccacggaggccgggtactggaaggccacgggcaaggacaaggacatcttcaggcagggcaacggcaaggcgctcgtcggcttcaagaagactctcgtcttctacacggggagggcgcccaagggcgagaagtccggctgggtcatgca

SEQ ID NO: 223 - DNA, 1163 bp, Saccharum
gataatgataatactgatgatattgatgctcactaatgattattgtttttgctatagattattctcgtttacatgatcatgaggttatttgggcttatggtaaacttgttgctactcaattgctaaaagatgacttaataaaagctatcgcagtaaacctgtgtcaaaccttttgagcctcatgaatcccatgttatatttgttgagttcgacatggactcactcttgctatttccccacatctcaggaagggtaccagactgttagattctggaattgttaggcttgtgatcaaccagttagtttgatcctggagtgaagtctacacccggtgttcggagttgtctttccgctgtgttgctctctaaggtatattttatactattgtgttatgtatattaagcatttgtctcttgatattacacttatctgtggctatatgtgagatttgtcttctttatttcacatatagtgtatgtctggttttgtccttaaaactgggtgtgacaaacaagatggtcaaccagatcagaatacataaatatggcgacaacctagaccttgaagcctctgctgttcctccttcctcttgccttctcaaacttccttcccttggagcgcacgtaaggcttcgtgtggctgtgcggcacaccaggcgcagggccaaagtgcttcacagcttccctagcattcttaggtcccctcagcagaaccgtgttctggcccagtggggcacgcagtgcaagctggtcaaaggtgaggcactcgccacccgcgttcgcaatccgggcccttgctgtctcagtgaacctgagcgcagccaccttcattgctggtacctcatacaccctcttgtcgtcagtcacagtgcccacaatcacagcaatttggttctccttgccctccatgaagttgacaaggcggcggagcgagagaggcgggcggttggtcttgctcatgaagagccgcttcaggatcacagcgttgaagttgctcttggtcctccgaacaaggaagcggtacagcttgacgaggagcttgaggtagacatcgtcggacttgggcgcggtgcgcttggtcttcttgttccggccgccggcgactaggtcgatacccattgcaacgcgcggcgagcagtgaggacctgcggcggcggcgcgggt

SEQ ID NO: 224 - DNA, 493 bp, Saccharum
ccacaagttaaaagctgagctcatatcccggatgctgtcttcatcttctcagcgattgaagatattttctatttggggggctggagaaatgggcaagaccactcttgcaaaagcagtctatgacgatagtaaagaggagttcaattgttgcgcctttgtttctgtttgccaacagcctgacatgaagaaacccttgagggacattctcatacaccttgcaaagaaaaggtacagcgatctttaacacggccatgctggatcaagggcagctcattgacgaactccaacatttccttaagaaaaagaggtaggcatcagccgcccgatattgataaatttgcctccaatttttttgacaattattgttcattcgaagcatacatattatttgtgtatttttagtacacctatatatataagtggacataattacatgtagcctatgtactcatacaatttcaaaatggagttttgccatgagtcaaagttttct

SEQ ID NO: 225 - DNA, 1019 bp, Saccharum
gaactagaaccgtgtaaaatggtatgtgccattttggttcactggaccatcagtccaagaggtctcaactgagctacaagacttcgataagactatctacacggcaagagttgccacttgccacccagcttttttacttgcaggctcgctacaagctatcaataccagggctacctggcaatctggcatgtttttctaccaggtgctccaataaagttttgatccactgatgtccatgtcacgtgtgcgatgagctgcttggcaccttcaacagtttgtgtcatacgttgccagcccttgtagctccgggccttccatccttggattattgtcgaagttgctcaatggtatgtgctcaaaaggcccactagttgggattgtgccgcaaagatcattgtttgagacatctatcactttgaggttagagatttttgtcagttcccgtggaactggaccagtcaagcggttgtcattaagtcgcaggaacaccaaggattttagcttgccaagttcttttggtatggtccctgtgatgttgttgttataaaggtccaagctgataaggctcttcagattcccaagctccgctgggatagtgccctcaatattattttggtagagttctagatattgcaggtgctcgaggtggcccagttcaggaacaagactgcctgacaaatttgagttacccaaatccacgcgggtgacgcggttgtcgcggttgcaggtgacgtggaaccaggtgcaggggttgacgagcgtggggtcccagctctgcagcacgcctcgggggtccgcgagcgcgcgccgcagggcgtagagcgcatcgccctccgagttggacgccaacaccacataggcaggcgacagcaccgccgccgcgaccatcagcgccacagccgccgccccggccatgagctggctggctagggtttcgactcccgggaggaggcggcgaaggggaaggggcgtggggaaagtggcgcggtgggggcgcagcactgcggcagtgactggtg

SEQ ID NO: 226 - DNA, 2661 bp, Saccharum
tccatcgcccccagcgtgtgcgcagcccccaacccacgcgactgggccggccgtcgctaacgccctacttcgcccccttcgccggcgacgagcaccaccagtcaccatgtcatcgtatcctgtgctaaacaaccgaccaatcgatcagtggagagttactgatctgaaggatgagctccgtaaaaggaagcttcctgttaaaggtttgaaagaggaactcgttaggcgactctttgactccattcagagtgaaagagaagctgaagaagctgatgaggatgtgggtgtgaatgtggatgatcagttacctgatgccaatgctagtgaggaaaatacagttaccgttacagaagttcaccaggaaactgtggttcatgtcactcagcaagttgaagttcctaccaccgaagttggtcaggaatccgctatttctcccactagaggggcccctagtgttgatcttgaagaggcctcaacagccaaaggagaagtacctgaatcatttgctggaggaaatttgacatttgaagaagtgcaagtgcatactaaaagtactaatgagcctgttcatgagaagaccacagacgttgacaccaatgaggcagtcattgtcaatgatgcaatcgatgtgaattcagacttgacccctgctgaagtcaagttttgtgctagggaagcaagcaaaattgaagaacaggattttcccccagcacctgtagatgccttaacttcagatgctgttggtcttatggatactgatgttgtcacagctgcaacttcagatgctggtcctatgggtactgatgctgtcacagctgaaccagttagcgacgatggggagaaactggtacccaaggatgatttgggtaacaaggtgtcaatgtatgatgaagagcacaataattctgataccatgaacgaggactgcaagcccatcatatcaaaaccaaataatcaggtacctgaggttagtccagatttagggtctcaaattaagtgtgaatcgatttctagtgataatctatcaactaacaaaaagaataatatagaagataatttaaatgctaataattttgatttagaactagaggttcagccgaagatggtcgaaccatcatccggcattacttcattaggtggagatttgcagccattggatgatgacaaagagctggttaagaaccagacatctttggaagacttagattccacagctaatgtggactcatacaagaaagatagtcctgaagctgggtctccagagaaattaaatctagacaggagttcaggtgatgagtcaatggaggaggatgttgccgaaattaaacaagttgagtccaatatgaaatctgatgatctcggaggaaacaatgagcttaactcaggagatgtgaaagaggtgatcctccctgattctgttgtggagccttcgaaggaggttatagctgaagaaaaatcagcagcttcagcagaaaagaggaaacttgaagctgaaggtgttacaaacactgaaccaatcaagcgacaacgtcggtggactgcagacgttgccaaagttccagagagacgagcattgagtcaaactggtcctgaaactcctaaggatatttttcagcctgctttcaaacgatcttttgggaggtctgattcaacagcaagtgtagattctcctaaggagcggattgtaccaccttctgagaaacctgccacaacttctttgagaattgaccgatttgtacgcccatttaccctgaaagctgtgcaggagcttcttggtaaaactggatctgtacaagacttctggatggaccatatcaagactcattgctatgtaacattttcttcggtggatgaagctgtggctactagggatgctgtttacaacctacagtggccgccaaacaatggcaataagttggttgccgaatttgttgatcctcaggaagtgaagctcaaggttgacccccctcccccgccagctgctcctgttagtccagctgctgccgcaagggcacctcctgttcaacagactcagggtaatcaaagtgtgccacaccaggctgctacaccaaaagagcaactgccacctccacctccccttgctaagccccctatcgctgacccggcagcattagcgagggagaggcttccgcccactccaaagaagccagagcctcctgttgtgacacttgatgatctcttcaagaagacacagtcctctccgaggatctattatctgcctttatcagaagaggaggtggcggccaagctcaccgcacagggaaaaggaaaaaaggaataggaggtgtcagcttccattttccgctagcttggagtttgttgcggaacatggcgtggggtggtcacagcagctgacaggtgctactgctgcagaccatttgaaataaccgacggcggtgactgctgtggcaaaagtgtagttgtagggctgttctctggaaaagtactagtgtaggagcagcagcagcttgtatttcctaaagagcttattagttttgattgggtctccgactagagtgtgtgctaaagttatttgagctacatcaagtgtctgaggtacttggtttaatttatgctgtcaggtactgttaaaagatactggttttagttttgagtctatgaaggatactgttactgttg

SEQ ID NO: 227 - DNA, 1589 bp, Saccharum
ctcgcacagcgggcggcctcgtagcagagtcccagtcctctcgctttctcaccgcgattcgcctcgcttccatccgattcgattcgggagccagaggagaggcaaggtaatcgccccgcgcgtgcttcctgcctcttcggtcggctccagctcggccgttcattcccgctccccccgccgtttcgccggatcgggtcgtggtagtcatgccgctggctgagccgccccagtggcgccgcaaggccacggatttcttctccacatccagtgtcaagctgaagcaggcagggcaatcggccggggataatatagctgatgttgctgggaaggttgggtctgtggtgaagagtcggtgggctgtcttccaggaggctaggcagcagcagcaacgtccaccgcatgagacagtgcaagagcgtatcatcactgctgccacctccactggtttgcttttcaggaaaggcatttcagagacaaaggagaaggttgcagtgggaaaggttaaagttgaggaggctgctaaaaaaactgcagataaaagcaagagtatcttgaacaatattgaacgctggcagaagggagtcgcaagcactgatgtgtttggtgttcctattgaagccactgtacaacgagagcaatctggtaaagctgtgcccttggtgctagtgagatgtgcagactacctggttatatcaggtttgaacaatgagtacttattcaaatctgaaggtgacaaaaaagttcttcagcagttagtttctctttacaatgaagattctggtgcatctttacctgaaggtgtaaatcctattgatgtaggtgcactggtgaagtgctaccttgccagtatccctgagccgcttactacattttcgctttatgatgaacttcgagctgcgagggttagcattcctgatcttaggaacatattgaagaagcttccaaatgtgaactacatgacgctagagtttgttacagcgttgctgcttcgagtcagccgtaaatcatcacttaacaagatggactcccgcagccttgctgtggaatttgcgcctttaatcatgtggcggcaaggtgatgctggcacagatttgcgtaaccacctcaagtttaccttgaaaccgcctccaaaaattgtggatacaacatcaaatacttccacatgggacctgttagacgaggatgatgaggatgcttcatctcaaattcccttggacgatgcttcacccccagactacagctccattgaggtcatccagtgtctcatcgagcatcacaatgccatcttcactgacgcaaatgaaaccgtgtggagatgatcagcatctcctctagatctagatctctctggtgttagctcgtgctatgtacaagttccaggtaggaaggtggattaccgctcgctattgttagggataagcattttggccggaacatttttggagtaggtttgtatatacgctagtgttaattctccactggtctagaatctggtcatgtcatatcaataaaagtgtacttggatggatataaaccagatgtgctgttttgatcatttgctgaattagcttatatgctactgttaatct

SEQ ID NO: 228 - DNA, 717 bp, Saccharum
gagaagaaagcacagacacatatatccatcatccacagctagctactagcgatggcatccaacaacaagtccgttgttttccctgtgcttctagccgtggcactcgtgttgacggcggtttcagtgcgagcgcagtcaccatcccaaaacccgtgtccttccggcttcactaacttcactgcgttcgttcaaggccagggcacttaccttttacgtggcatcacgttgacactcctccttgccccggtcaccccaggcaccagcaccacaaactgcctttgctatcccactaccaacaccaccattggccccattgtcgtgcccaacctcaatggccccttcgcatgcgtgcaaggcccaatatgatgcacacaccggaattcagcatgctggcagtctggcacgaacacacagcacaaatgtgcacatatgcgcacttagctatttactcctactatatatatatgctatgtactacgtatatgaataacttactcccgtctgtgtgtgcatgcatacgttgtatgcatgcggagactaattcacatgttacgctatgcagtggcatgtaagaggagttggcccacaacctactttatatatatacaatacaataaagaaagacgatgtaatgtgtgtcgtgttcatgttgttgtaagcatgttgttgtaagtgtactcagaataccaaatatatactggaaccatattaattaaa

SEQ ID NO: 229 - DNA, 3071 bp, Saccharum
agcgcatcgcctctccccgccatttggcccggaacccctcgcggcctcatctcctcctcgtcatcgtaaacaccccacgcgtagagtttgtcagggtcgcctccagtggatctcgagagtccgattccccaggcgctgctgttaccttgggtggaggcaagttggaactgcgctgtttgcttcacagacttttccttctgaagttttgcagcctctgatgaggagtcggaagcaactgattttgagcgtcgcagagcacatggcttaagaataatttcttccagcccggctacatattcgtagttggattcagcatgtgcattttttatgctgacataggatgtgctccaccatctgtgaactccctctagttgcacaaaacaaccactgcggtgctctctctctctcttcgaatcaggctaatgggtagcgcttgccaagctggcacggacgggtcttcccgcaaggatgtgttgggtatagggaatgtcaccttagataatggccaccatgaggctgaagctgatgcagatgaatggagggaaaaggaagatgacttagccaatgggcacagtgcgccaccgggcatgcagcaggtggatgagcagaaggagcaacaaggacaaagcattcactgggagaggttcctacctgtgaagacactgagagtcttgctggtggagaatgatgactctactcgtcaggtggtcagtgccctgctccgtaagtgctgctatgaagttatccctgctgaaaatggttcacatgcatggcgatatcttgaaaatctgcagaacaacattgaccttgtattgactgaggttttcatgccttgtctatctggcatcggtctgcttagcaaaatcactagtcacaaaatttgcaaggacattcctgtgattatgatgtcttcaaatgactctatgagtatggtgtttaagtgtttgtcgaagggagcagttgacttcttggtaaagccactacgtaagaatgagcttaagaacctttggcagcacgtttggaggcgatgccacagttccagtggcagtggaagtgaaagtggcatccagacacagaagtgtgccaaaccaaatactggtgacgagtatgagaacgacagtgacagcaatcatgatgatgaagaaaatgatgacgacgacgatgacgacttcagtgtcggactcaatgctagggatggaagtgataatggcagtggtactcaaagctcatggacaaagcgtgctgtggagattgacagtccacaacctatgtctcctgatcaactagcagatccacctgatagtacatgtgcacaagtaattcaccccaaatcagagatatgcagtaacaagtggctaccgacagcaaacaaaaggaatggcaagaaacataaggagaataaagatgaatctatgggaagatacctggaaataggtgctcctaggaactcaagtgcagaatatcaatcatctctcaatgacgtatctgttaatccaacagaaaaacgacatgagactcacatgccccaatgcaaatccaaaaagaaaatgatggcagaagatgattgtacagacatacctagtgaaacaaatactgaaactgctgatttaattagctcaatagccagaaacacagaaggccaacaagcagtacgagccgttgatgcacctgatggcccttccaagatgcccgatggaaatgataagaatcatgattctcatatcgaggtgacaccccatgagttgggtttgaagagattgagaacagatggagctacagccgaaatccatgatgagcgaaatattctgaaaagatcagatcagtcagccttcaccaggtaccatacatctgtggcttccaatcaaggtggagcaagatgtggggaaagctcttcaccacaagataacagttctgaggctgtgaaaacggactctacatgcaagatgaagtcaaattcagatgctgctccaataaagcagggatccaatggcagtagcaacaacgatgtgggctccagtacaaagaatgttgttgcaaagccttcggctaacagggagagagtaacgtcaccatcagccatcaaatctacccagcatgcctcagcatttcatactatacataatcaaacatcaccagctaatctggttgggaaagacaaagctgatgaaggaatttccaatgcagtgaaaatgagccacccaacagaggttccacaaagctgcgtccagcatcatcatcacgtgcattattacctccatgttatgacacagaaacagctatccatcgaccgtggatcatcagatgttcagtgtggttcatcaaatgtgtttgatcctcctgttgaaggacatgctgctaactacagtgtgaatgggggtgtctcagttggtcataatgggtgcaatgggcagaatggaacgagcgctgtccccaatattgcaacaccaaacatagagagtgttaatggtaccatgagccaaaatatcgctggaggtggcattgtaagtgggagtgggagtggcaatgatgtttatcagaatcggttcccccaacgagaagctgcattgaacaaattcagactgaagcggaaagatcggaacttcggtaaaaaggttcgctaccaaagcaggaagaggcttgctgagcagcggccacgggtccgtggacagtttgtgcgacaatctgggcaagaagatcaagcagcgcaaggttcagaaagatgacacggaccttctaatacaacatggcatcttcgtcgacagatctgagaattaggcggttcttcccattgcgcctcttcatcgacagatctgagaattaagtggttcttcccattgctgatagtaacccattgattcccaacgttagagtactcaataaataagactctagtcgtcaatttctgttgtcgactccagatgatcaccctagtgctatggagtcaaacatgtaatatttatatatgttcgagccttggcggtttgcaatcttcattttccttgcagtgatattcttggccaagtgtcttaaggaggagcaaaccagcagcgtcattgctattatattactat

SEQ ID NO: 230 - DNA, 1470 bp, Saccharum
  misc_feature 1433, 1434, 1435, 1436, 1437, 1438, 1439, 1440, 1441, 1442,1443, 1444, 1445, 1446, 1447, 1448, 1449, 1450, 1451, 1452,1453, 1454, 1455, 1456, 1457, 1458, 1459, 1460, 1461, 1462,1463, 1464, 1465, 1466, 1467, 1468, 1469, 1470: n = A,T,C or G
ctccgactcctctccctccggccgttggagcctttggaggacgggccgacggggggacaaagcaaaatcgcatcgccaccagcttcgacctttctccctcctccatccatccatctctctctttcttccttccttccttcctcttgacggaagccggtttcgggcgtcctgctcttgctcagctcgacagctcggcaaccccgcggaaacagaggccatcttcttggttacttggtgatctgtccctcttgcttcggcttcagagaggcgcccagcgcgcagcggattgcctccgttcgtcctcggtgctctccgaagagagagttggagatcgagatcggaaggcgtaaggatttgtttcccatggggaactgcttggggggcagcccctcctacgtcaacaaggtctcctccactgcgaagcagagactcctaaggtgcagagcccgtcggaagtggaccggagcgacgaccgcaagatgccatcgaacccgagcgaggtggaggccctgctgcggggcgcgtcggcggcggcccggaacccgctggtggccttctccttctccgagctcaggaaggtggccaacgacttccgcaaggaggcgctcatcggcggcggcggattcggccgggtctacaagggttccttcgcgccaccagccggcgcagacgcagacctgagcggcggcaccaccctgccggtggccatcaaggtgcacgacggcgacaacagcttccagggccaccgggagtggctggcggaggtgatcttcctgggccagctctcccacccgaaccttgtgaagctggtgggctactgctgcgaggacgagcaccgcgtgctggtgtacgagtacatggcgctgggcagcgtggagtcgcacctcttctcccgcacgtcgccgccgctgccgtgggcgacgcggatgaagatcgcgctgggcgccgcgcgcgggctggcgttcctccacgacgccgagccccgccccgtgatctaccgcgacttcaagacctccaacatcctgctggacgccgacttcaacgccaagctctccgacttcggcctcgccaaggacgggcccgtcggggagcagtcgcacgtgtccacgcgggtcatgggcacctacggctacgccgcgcccgagtacatgatgacgggccacctcacggcctccagcgacgtctacagctacggcgtcgtcctgctcgagctgctcacggggcggcgctcgctggaccggtcgcgcccgccgcgggagcaggcgctcaccgactgggcgctcccggcgctgccgcacaagaagcgcgtgcagggcatcgtcgaccccaggctggcgggcggcgccggcggatgggacgacccgccgcccgccagggccgtgcagaagacggccatgctcgcgtaccactgcctcaaccgcaaccccaaggcnnnnnnnnnnnnnnnnnnnnnnnnnnnnnnnnnnnnnn

SEQ ID NO: 231 - DNA, 1156 bp, Saccharum
aaggaacaataagatggcaaatattatataggtagcagctgttcataattaaagggtgcgtacaatccaaccaacaacaagaataatagcaacagtaacacggggtaaaagtacaggatggtggggatagatgcatgcttgcgtacggcgatacggcatagattatatatatagctgatggtactcgatcctgctgggctaccgcaccatcgatcgacctctagatgctgcgctcaatctgcttgaagatgtcgaagctctcgatgacttgctccttggccctatcctccagatcaaagcgtgcctcagtaacctgaggagtgggcacaactctaggttctggagcgctgttggaagtggcagcagaggcagtcgtcgtcgagcagcgcgggtcgcactttgcccagttcttggcagccatgctgaaggcctccctgtgagggatatctggcttcgcagctttgatgcgttgaatctcctccctcatgaagcgattgtaagcagatgggaggcggtgtttcttctccgggggcttgacaacgaagggcattctcgggctgagctcagtcgatgtcggcgaggccagcggcaacggttggttcctcccgcactcattgcagggtccctgacactggaatggccccaaggggtgatcagtcggcgagagcggctgcaccatggggggccgtggactgaggtaggagaggttgttgcagtggccgcacttgacagtcaccgtgtccatcagcctcttgcatggaaccccaaccgcgagcacggtgttgcagtaggtgcagcggacgtagcacaggtgctcggactgcgaaaccatatccatgcttgcttggtggccggccggcgtggaggtggcggcggcgcggcgggcggtggtatatatgttcgaacttcggaggagcctcgctcaagggagagagcaagcagcgtgtgtctggctgtctgctagatgtgtggtgaggcgatatactaataaggcagcaggcaatgaagaaggggaggaggacgggaggtagaagaagaagaagcagtggagcacgccacgggtagagagagaaagagttgggttccaagagaagatgggcgtagggtttctattcctgcaataatgcctgggccccacgcacagatagcgatcggg

SEQ ID NO: 232 - DNA, 680 bp, Saccharum
catacaaaaatgcaccttagcagtaacagattacaccaccgtaatgttcaaccgcttaataaaacatctcgtattattacaacacgggcatagcaacataagtgcggagaaaatcaccaagtcttcagaccatagaaacctagatcaagggagagacagagagtggtaggacaatgatagaggagatacagacctatgccttcccagcaacaagcttgtcgatgaggtcagcagcgtcttcaactgttgcgatcgtctgggcgctggactcctccacgctgatatcgaagtgctcctcaaggcccatcacaatctcaaccgtgtccagtgaatccgcaccaagttcagagaatttggagtcaccacaaacttcagtgtggtcaggaagagcaagctgcttcttcacaatttcacaaaccttgtccactgtatccttcttggcagcgcaggaaacagatctcatagtcattggttgcaggcggaggaatgcatttcccttcctcaccgtggagaaagctagagagtttgtgttgattgccttgacgggcctggcgaaggagagcgcggaagatccggcgatggaggccatgttcgtcagacaagcacgagaagaggggaggcggcgggcacgaagagcgtgagagcgacggggaggtggctggccgcagctgggtaggttg

SEQ ID NO: 233 - DNA, 1592 bp, Saccharum
cggtccggaattcccgggctccagccttttccctgctgtgccgcgcgccctcccttctctctactgatagcatagcatagagagagtacttcgaggagctcgcggggacagtgggcggagagctcgatcgctgcaccactacttcactggagatccgcccactccgatggaggagatcacccaccactttggagttgccgcaagcagccacagccacggccacggccagcaccaccacccgtgggcatcctccctcagcgccgttgttgcgccgccgccgcagcaaccgccgagcgcaggcctgccgctcaccctgaacacggtggcggccactgggaacagcggcgctagcggcaacccggtgctgcagcttgccaacggcggcagcctcctcgacgcgtgcgtcaacgtcaaggcgaagggcgagccctcgtcgtcgtctccctacgcaggcgacctcgaggccatcaaggccaagatcatctcgcacccgcactactactcgctcctcgccgcctacctcgagtgcaagaaggtgggggcaccaccggaggtgtcggcgaggctgacggcgatggcgcaggagctggaggcgcggcagcgcacggcgctcggcggcctgggcgctgcgacggagccggagctggaccagttcatggaggcgtaccacgagatgctggtgaagttcagggaggagctgacgaggccgctgcaggaggcgatggagttcatgcgaagggtggagtcgcagctcaactcgctttccatctctggaagatcgctgcgcaatatcctttcctctggctcttctgaggaggatcaagaaggtagcggaggagagacagagctccctgaagttgatgtacatggtgtagaccaagagctcaagcaccatctcctgaagaaatacagtggctatctaagctcgctcaagcaagaactgtcaaagaagaagaagaaagggaagctccctaaggaggctcgccagcagctccttagctggtgggatctgcactacaaatggccttacccctcagagactcagaaggtggcactggctgagtctaccgggcttgacctgaagcaaatcaacaactggttcatcaaccagcggaagcggcactggaagccatctgaggaaatgcaccacctgatgatggacgggtaccacaccaccaacgccttttacatggacggccatttcatcaacgatggcgggctttaccggctcggttagccaccagcgatgcttccatttcacaccacgacctagctaaagactaatggttccaaatgtctgaagtactgaactactgaaggcagggctagctatctaatgttgtgtgccgcatgcatgagctgtaaggaggccatgcttaattatttgttaccattgctactctatctatgcgcctatgcttccgtgcatgaactatgctttaagtactgctccacaatgtggtggtgtgcttttgcttttgtgtggttgtatgcgtaacctgacagatcgatcgctgattgctacatgtctgaataatttgcatgatctagcaggtttccgcctaatctaatgatactgctcaggtttcctc

SEQ ID NO: 234 - DNA, 2473 bp, Saccharum
agccccccctacggccatgatttacatggttcccgggctaccgccatgaggaggaagaagaaggcaaggaggggctggaggaagaagaagaggaagccagccctggcttcgacgattcctggcttcgtcgctgccctggatcgtacttaatttccgcagtcaatcgtctgcatcccgcttatgggtggcgtgcttgagctgggtacaactgatacggtgccggaggacccggacacggtcagccaagcaaccgcagctttcttggagccgcaatgtccgatatacttgcaagagccaagctccaacccgtcagcaaacgaagccggcgaggccgcagacattgttgtgttcgaggacctcggtcacaatgccatggagacgataactgccgccggaaatgaacccgtcagcctgtcaaacgcaagcctggagcacatctcgaaggagatcgacgagttctataccctctgcgaggaaatggacgtgcagccactaccactagaggatggctggatcatggacgggtctaatttcgaagtcccctcgtccccgcaaccagcgcccccggggaacctagcttatggctctcgctcggccagtttcatggcgtggacgaggtcctcgcagtcgtgctccgatgaagcggcggcagtgccggtcatcgaagagccgcagaaattgctgaagaaagtggtggccggcggcggaggttgggcgaactgtggtggtggtgtgggcacgagcacgacgggaacagcccaggaaagcggcatcaagaatcacgtcatgtcagagcgaaagcgccgggagaagctcaacgagatgttcctcattctcaagtcattggttccgtccattcacaaggttgacaaagcatcgatcctcgccgaaactatagcctacctcaaggagcttcagcgaagggtacaagagctggagtccagtaaggaacttacatcgcgcccatccgaaacgacaaggccaataacaagaccccgtggcattggcaacgagagtgtcaagaagaaactctgtgcgggctccaagaggaagagcccagagttcggcggtgacgtggagaaggagcacccctgggtcctccccaaggacggcaccagcaacgtcaccgtcgccgtctcggacagggacgtgctcctggaggtgcaatgccagtgggaggagctcctgatgacgcgagtgttcgacgccatcaagggcctccatttggacgttctctcggttcaggcttcggcaccagatggcttcatggggcttaagatacgagctcagtttgctggctccggtgccgtcgtgccctggatgatcagcgaggctcttcgtaaagctatagggaagcgatgaagggacagctgaaagttggatatcgatctggagagcttcatgaatcgaagcggaagttgtatttcttgcggagaagggcccaaatcgtgctatatatgcaacacatttttgtcaggtgtatttgcagggttctgcacttcagtttttgtcaaaaaatgaagtttggacggaaacatgtactcaaactgaaagctttgctggcgtcagcttattcatctgatcaaaacctaatttttatttgcctccctggagcaggctttgacacgcaaaaatcattgcccgacagctaataggttgtgcagtggtctccgaagtcccgaagccccgatcactcagatagtccgattctgtgttgggagatggcgaccaatggaccctgcgaaatttactccgagaggagccaggggcgtgtcggttatttctataccaatagctttctatattggcatactgcgagttgcgacagcgcgtcgtggatgggtagatgtccagctcgtggtggactggggcttcgtagccgtagctgtagcttcaccttcgcacatggttctccgcctgtagcgcattcaaatgcaattgttttgctgccgtcacgcgctatgcgtcttcgtccaatcgtcctgctgctatgagacattgagaccttggaaacgtgcaagcagcaagtctactactcttctagtctagatcatttaaaacattttggaaaggttagggcaaatgaatactagtagtacacaaacgcttcaagcgcaaaaggtgcttgtgtccaagtgggagccttccgcctcacagcggtcggatacccaggttgtgacagatttcaagaagagactacagtgcccgctcgactccgcaaaaagggaagcacttcgagcgctcttgaagttcgatgtgtcggggtttgagttcgaagggtttgagggggcttgctagtctcatagccatccacccaattggttgctcaactttcatgtaatgtctttttaagttagtcttttcgggtcgtgttggcttccattctcccacggtaatctatggattacttgggggatgttgtaaccagtcaaactctgcttctggttaatgaattacgtgtcgcaaagacacg

SEQ ID NO: 235 - DNA, 586 bp, Saccharum
cggacgcgtgggcggacgcgtgggcggacgcgtgggcttctctgctcagcctgctgctcatgcaacacagcgccgctcccgcgcgaaaccaccggtaccacggcgctcggctcaccggcgcgcgcgtgcggcagggccgcgcgcggctccgtcgagctctgcagccgggtgccctcatgtggcgcgacaacggcgacccgaaaaccggccgaccggcggtgagatgcgaccaaggcgcggcacctgtgcgggcgggtgcaagcgccagtgcccctcaaggccgcggcgacggcggcgctcctgatgcccgggaagccaatttcagcagcggcgcaagaccagcgtggtggcggctgctacccgagaccctcacacgcgcagcgcagggcggaggccctgcggatccacgcggcggcgccttaagccaccagcacgggtacgagccacgtgggtgcacgctccatgtctgatcttagagttagtgttttgatttggggattgtgtttatggctgcttatttgattcaatcccctccttctaaatggttaactcggtttgataaatgttgaattaccctcagttgcag

SEQ ID NO: 236 - DNA, 619 bp, Saccharum
cgccggcaggcccgcactccctgcacgagctgcaggacaccacgctgggctcgctgctatccgcactcatgcagcactgcgacccgccccagcgccgattcccgctcgagaagggccatccgccgccgtggtggcccgtcggcaccgagccgtggtggccgcaggctgccgtgccgggggagctcggcccgccgccgtacaagaagccgcacgacctcaagaaggcctggaaggtggccgtgctcaccgccgtcatcaagcacatgtcccccgacgtcgacaaggcgcgccgcctcgtccggcagtccaagtgcctgcaggacaagatgaccgccagggagatcgtcacgtggctcgccttgctcaggcaggaggaggagctgtacctccagctgcaccccggtgcccgccccgcgctgtcctccgccgccgccgccgtcccgacgatcccgttctgcgccagctctggcgagtacgacgtcgacggcgctgacggcgaagacaccggccggaaccaccagccacgctccaacgccggcgccgcggttcgtggacctttcgtcgtcgtcgtcgtccatggacgacgcgggcaacaacaagttcgtgatggccgcgcccg

SEQ ID NO: 237 - DNA, 649 bp, Saccharum
cgcagcattataatggtcagcttcaagatggttcacgagtactggttagatgtttgaggctgaagccgaagtactccctccagagccttgtccaatacatggagattatttctaagcttcggcaccgtcatttggtcagcatcattggtcattgcattgtcagtgatcaggagaatcctaatatatacctcatttctgaatgtgtaacaaatggatctttaagaagtcaccttactgagtggaggaaacgtgaaatgctgaaatggccacaacgggtttctgctgccattggtgttgcgagaggggttcagtttttgcataatgtgactgctccagggatcgtgcagaataatctcaacatagaaaatatcctgctcgacaagaccctcacatcgaagatcaacgacttcagtcttccaatgatatcaactagcaagaacggcaagatcttctcagagaccccatttgctgtccatgaagataatgatattggcagtgctcacaatgtggaacaaggtgacaagcaagacatctaccagattggcctaattctcctggaggtgatcacaggcaaaccaacagagtcccaaagccaactagagtccctgaaagctcagctaagcaaggccatgtctttcagcctgtctgg

SEQ ID NO: 238 - DNA, 608 bp, Saccharum
ctcctccaacaccctcccctcgctgcgactcgagtcggcgctcatccgcaaaaaccgcatcggctccaaggaagttcatcgagaagtgttggtggacatgggtcagatccagtactccgagaagtacttcgacgacacctacgagtacaggcacgtcgtcctcccgcccgaggtcgccaagctcctccccaagaaccgcctcctctccgagaacgagtggcgcgccatcggtgtgcagcagagccgcgggtgggtgcactacgcgatccaccggccggagccgcacatcatgctgttccgccgcccgatcaactaccagcagcagcaggaggcggctgcagcgcagatgctggccaagtgagcccctgctggcaagggcggcgaccagaaatgtttaaaaccctagtccccttttcatctctaaaaggggcgtcgctattctgttgattaattcctgtgtctgttggttggaaacctgggatctagttggtcgacttggtggtgtctgccttgtgttcgtggaaatgtctgtgaaggaactgccatgtgttaggctgtgctatcatgaccattttcttaatattatgttactatgtgatcgggatgac

SEQ ID NO: 239 - DNA, 1105 bp, Saccharum
ccactctcgacattcaaattcaactctccccatgggcattggcataaagtattaatacaacacatgtatgtgtattgaacgaaataaaaaaaatataagatgcaccttataccgcaatccataacaatccatgcagtgaaatactagcgactcgcataccaaacgttccaaccccaatgtactaagtttttaacaaaatcaagcccggaccaaaccagactagaccaaatccaaacatctgagactgctccaactcgcccccaaatgttagcagtcatatttcatggcaaatgggcaccaaacttccactggaaggacacaaactgatttggcaccgggaggatctgccaccaccaactactcagctggggctgtgtcggctttggtttcggtcactttgccagaatcagtggactccgacttgtcactttcctcagatttgtgctcactcacagtaagcttctccagcaatccagctgtggaagaaccatcttcactttccttgccctcgttctttgtaagcgactcagaaatctcctcaaccaactccttgaacttcttacaattttctacggaaccaaacctgatggcaaacatctcctccttgagttcgccatcggcaaagtcagcagcgtgccagacgcatgacttgtcgctgccggcatgctcctgcatcttcgtggtcgaggccacgaggtggttcgcgcagatcttaagcgtcttggcctggcgcatgacgagtcggaccttgccggtctccttgtgcttgagaagcttgacggtgccggtgccccgttccttccattggttcccgtctttgtcaaatcggtacaacttcgccttcatgtcgagcaggacgtcctcgtcctcctcgccggtggtgacgtctacctcctcaagccgcacgatgggggccacctgggcgcccgtgtcctcctcctcccccgcggcagcggcggcggctgaggcgtcctcctcctcagccgcctcgggtcgctccacgacaggctccttgtccgccatgagatgaggtgatcgcggcgcgattcgattcgaagaggacgcgacggcggggctagggtggggagacgggtaggtgttctcc

SEQ ID NO: 240 - DNA, 3108 bp, Saccharum
tttttttttccagcagcaaagcttcagagctgcagaatcgctatatttctttgggggtacatgcttcttggccttcactggacccagatcattatgatggactaattaggcaatacaaagcagccatctatcaaacttatacaaaaagggtcgcaacaagatagcctgcttgcattgcatctccaagtctaggagataaaccaagtcctacaaacttacaggttacaccagaagctggcaagagagatctccttatcactctggaacaacttcatcttcactaattgccttgttcattattttagtggacacatccacgtcttctttgggaccatctccggcgtctgtcttcttgtccacaggggtggaggatgaggtgttgctgctgccatcatctccagctccagatgtggacttttggacatctgttaccagagccaaggtgccatttggaggagaatccaactcaagcgacgatgtctggttagtcaaaggctgtacttggttgccaagcactgccgttgaattcacttgttgacctggatgacctttcaaagttaaattagtttgctcagggttgctggtcaaatttgctggagatggatgggtcttgctttctatgtcatcgctaggaatgtctgtgtttttctgggtagatgaattagtcggagtagccgtgctgtccatggtggcatatgatccattaattccaggagctcgaaatgaaattccattagataagtttgtggtgccttcaaatatcctatccatgctgttcaattgttcctctgggagaggttttgccaccttggcgtcatgatccacagagcttgacacatcatcacctctgaaactcctttccctagccctgcgcacttcctcctccttgtttccagcctcatgattttcattaggcactgcagttgaagcatcatccacaaataagacctttttttgggcatgatggaacaactcatcttgctcagacaatggagggtcatgagtaacagcactagaaacattgtcaccatggaaactcttctcttgatcctcctgtgaccgctccttccgcttttcgtcctcaaacacacccacatttccatccttttcagaagaatgctcaccaggctcaggaagatcctcgtcccccccccccttttttttttttttttttttttttttttttttttttttttatggattgcaaccatgatattgacttcatatatcaataagaactatacaagtccattcatattgtaaatttccttggcaaggaaattgcatattaccctaaggaaattacaattttccttggcggttcagaacaacacccaaggaaattcatttccttggtggtgcatataaccctccaaggaacatacattttcttggaggttgactagcactgacgaggaaactatatatttcttggtcctcagaaattcttaaccctcaaaggtaattcggatttaggacggaccatgcagagagtgatcgtattggcctcagatcacagacgtttttatttatttcatacatggtgccaatactgtacatgcacatacagtgctagcatgagatcgaaccaatagatcatgcatcttgacgccattttttggttgacacagcctcaatagcggagcctagaggccacacagcttcgacgtagtactctccatgcttcaccctgtccaccacggtgatctccttggtcgcctccacaccaaagccatctgctagcaacgtatactggtaggcaaggtccatgcataggtatggcacatcgacatcgttgacgtttgggtattcaattttggcttcttcaacactcatctggcaagccttctccgcggaagctccgaatgcgccaggggtagtttttccgcttggtgcattgacatctatgatgccgacctctgtggccacgtagtagaagctggatgcaacatagagattgtcttggcctgctccgccaccaccattccatatgccattgaaagtgcagttctttgtttcacatggcgcgttcaggttcagtgctttccctatctcttctctgcacttgcagtagactgctccttctggtgcggcagttgcatcgtactgctcctcattgtaggtgtattcaccactgaatccacgcaacatgcagttgctgaatggcccattccttgccttcaaaatctctgctcgtgatgcaaaagcaccatagtgcaagtaactgtgagcatagatgttgtaatcttttcctttaagatactctcttataacataggggtcttccccaagaggcgacaccggagcatttgcagcagtatttgcagaaatggcataggccatttgcactgatccaccgcccatatcaaccacggctactgtctgtgagtagtcccctcccaatttatccaacagataattcagagcaacccataggtatgatccttcttgagatccctcaataacattgatccactcgggcttgtactgaaatttgctcttagtgtggacaaggttcctgactgcttcaagaatctgcttcgattgctcttctccgataagtctcaacccagcagtcgctccaagtctaagcggggtccttttcataagctgtttagggacgacacttttggccttgtcaagaagaggcagtatggaatttgcagcctcttggggatgtccagcgtatgagctcagcccgggcttcaccttagcgaacacctcgatgccttcgtcgccgatctcgaggagctccagcttcctgtcgaacctgaagacgtgcacacgagtccccgtgctgccagcgtcgaagatcacggcgtacctccccgcccccggctgtgaactctcgggcgccgctgcctcgtcaacgacgatgccagctttccggccgagcacggagtctgctgcaaggaccgcgctgctggggtaggacgacgaggacatcagctgcaggaggagcagcgccgcgatgccgacgacgaagtgagccattgctgccagctgcctgctaatgcagtggcaagtggcaagcctgtgaggcgtgcacaagtcgtcgcacaccggctggccggcggaggacaggggagaggccggcgggcgcgcgtg

SEQ ID NO: 241 - DNA, 2078 bp, Saccharum
gaccaaggaatgaattcagatgattcagttaagggttccaagcgtctcgttacaacgtgccgtgttcccagtttatatatatagatatacatacatgttgcgtaagtcatagttgctgttccaagggatatacatgatatataagatgatgagataaacaaaagatttgggctagagctacggaacccatcagctttcccatacgagccccctgcaacggtgcatcttatacgagataataacggagctctgaaccctactacaatcagaattatctcctctcatttcagagacggacagaaaaatggcaagtgaatgagcttgccaattcctatctttgcatttattgagacttttctatgtcagctgcagcctttattcacaattgattgatgggaagtcgaagtggagcaaaaaagaatccgagacctcattccacctatggcagaaaatcctgagaaggttgcccaagatctatcttcatgacagaaaggggactaatgctctcaaactgtgtctcattacgatgcttgcatgccagcagctgcagaagccggggatcggataagcgtgtggggagcataaacctttgatatagacccaacaggtccatatgtagttccaggcgctggtggattagcagagcaatccttgactagagtgtattgtggacgcagatcagaagatggcagatatggaggcataggagtaacagggaaactgtgaggatatggagcgactggcacatcagtaagtgatgacgctgaaatgctatagtttggagtacccatcgggtgatcaaacttgcatgtcggcccaaacttgcaaaacccatggtgtgcatagtaagcacatggctgagaaccaggacgcaggggaagacccagagagctcagtatgcaattagactttggtccactgaagtattgaggatgatgatatttgcagactgctccatatttacaggttccagtcttcatgtaatgttcacattcaggctgcccaggccgctctggaaaggcatattcttgtatgttgctgcttgaagtcccagttgaagaatacaattgcgcataatgactgccataagtcacggcagaggtaggcccctggtgcgacaagccataagatgccgctgctggaacagcttgctgtcccccagctggtgtaacttggttcataggtgaaacataagggttccatccctgcattggcataactgtaggtggaagcatcattggtggatacgagcctggtaaaaatgaccctggcacaacaggaggcctccccatttgccaattggcaagatgtggatatggatgtgaggaggaaataggtgatggttgaactggtgggtacatgccaggcgtctccgtaagaaaaccaagttctgggtgatggaatttacatgtagctccaaacttgcaatgtccagttttcatgtaataggaacattccttttcacccagacgtagagggaatccactgctgtttaatgtgacaggtacaaaaccaccttccctgggatgatcaaacttgcaattggaaccaaatttacaggtgccattctttgcatagtactcacagagtggctgtccaggacgctctgggtactccaccatacctgcggtctttccaactccattaaccggggccggccgatcgggggggtggttgtagcggcagcgctccccgtagccgcaggcgcccgtgcggaggtagtaggcgcagtccgcctcgcccggccgctccggaagcttctcctcccccgcctccccgtcctcgccgagccccagcctccgcatcgactcttccaggccggtgccggcgtcggccccgccgcccttcgccgccgcgtacggctccatccgacggacggcccccggaagctcccgaagcgcggcgatcgggcgcctgcctcgccgacggaccgggctcgatcgaagctactgcaggcgagcgagcgagcgagcaccggaacctcacggagccagccaaagggaagaaaaattattccagaaattttttcctgcgctgctgcagtgatccctcgcggttccttcctggcgactcctctg

SEQ ID NO: 242 - DNA, 856 bp, Saccharum
ttgactaggatatgttctattgggtgcctcagaagctgaaaggtaagttctataggacgacgattcgtccggcgatgttatacggtgctgagtgttggcctacaaaaaaggcgacatgtgcagcaattgagtgtagcagagatgcgtatgttgtgttggtgttgtggacacacaaggagggatagagtccggaacgacgatattcgggatagggttggggtggcaccaattgaggagaaattgattcaacatcggttgagatggtttggacatgtccaacggaggcctcctgaggcgccggtgcgtagtggagttctaaagcgggccgataatgtaaagagcggtagaggtcgacctaaactaacttgggacgagtccgttaagagagatcttaaggagtggaatatccccaaggatttagctatggacaggagcgcttggagattagcaatcaacgtgcctgaaccgtgacatctttttgtcttgtgccctttatgtccctttatgtgtctccctgtttctcgtctcttttgggtttcatctctagcctaccccaacttgcttgggacaaaaggctatgttgttgttgttgttgttgttgttgtacttctcaatgtttctatgagtgatgttaacatctgacctataattaatctagtcaagggggttagaggcgacagactagtagggggtataacttttattgtcctgtacatgtcacaattatgttcaccgtggttttgttccaaaatgtaagtactatatttctgtctttaggagaatgggagcccaaaaggcccaaacccatgtgatgttgacggtgcagtagccaagtggcgctagtgcccccttaatg

SEQ ID NO: 243 - DNA, 2285 bp, Saccharum
gcgaggactcctcaaaagaaccactccctccctcctccgcgtactctccctcgtgagctcgtcgctggctcgctcgctctctctcctattcactcctccccgcgctagctaccagcagcctctcgcttaaagagggaggaggggggcgaggagcaatgtcggagcagcagccattgccgcagcctcggagcagcatgcgggaggcgctggagaaggaggacaaggagaaggcggtggccgccgcggccaaggagaaggcaaccgttcccaagaacggcggcaacggcgggggcggcaagaatggcggcgggggtaacggcggaggcgccccgccgtccggggaggagacggcccgggagattcaggtggtgagggaggcgtaccggcgcgagacggccgcgccggcgtacgtcatccccgaggagccgccggccatggtggagctcgtgggctggtacatctacggcttctgctcctacttcatcacccacctgctgctgccggtgctcttcccggtcatcgtcacgcagatcgcctaccccaactccgatttcacgccggaccccaagtacaccctcaagggcgccacctgctccgtccatgagatgtccatgtaccaaaggcttaccaagcactccattgtgattgatggatcccggatgtcacctttgggctggagtggtctatcatgggcaattggcatcctcatcgtggcgccgctcctcactcagactgctcaccatctcgaccgtggccagtatcaatcgctaatcctcattgctgccacgtcctttgggtcgttcttctgcctgctcacaggtttcttcaagacggtctgggtgttcctattctacatcatcttcattgcaggctcaatcattgtcgccgaggcagtgcatacccgcaaccttggtctgatgatccgtggccttgctgcgcatgactcaggcaagcaccttgttcttcgccgccgtgctgctgcgagccagctcagcctgtactgcactgccattggaggcattggagcggccctcatggctgcattcatgtaccacatgctgcggcgcactgatcagctcactggcctttgggttgtctccatcttctgtggccttatctggttcattggcatttgccatggtctcttcacaaacaggcccagcagctcatcacccaccactgcatttgagcccaacttcttcaccaagctcagctacagcatgacccttctgcgttacccgcaggccattggcagcttggttgcagtgttcctgtcctctttcgccacaatgtgcatcttcaccagcggcacactctatgctatcggtggtgtttgcatcaagccagtgcttgtgcttgtgctatggatcctttacttcctgttccccttgatctcacttccacttctccacccaatccagatcataatccgtgctgatgctgttcgcatgcagctgcttgggttcataatctgcctattcgtgtctggtgctgggttctacttcaagagccacaggtggagagctgcccacatcattgttattgcccttgtccagagcactgccaatggcatattgtacgcatttggccgcattctgctcctcgatgcctcaccaccggggaaggagggtgcattctcggtctggtatgcatttgtccgtgttactggtgccatgattggctttgctgcttcctctgctggccctgggcgtgccggaggatcattcgccgctgcattccttgggagcttcctgggcatcattgtgctgatctttggcaatgtcagcaacattggggcgctgaaggctgctgggcacctcaagggaatggacgatgagaaaaggatggagaaaggcgaaggcatgggtggcgccgtcgctgattcaggcgaaagcagggggagggtatgatgacaattcgtgaaggtgtatttctgggaggggaaaaaagattgcattctgtggaggttgtgtttgtgagaaggatttgttctcttctttcttgtttcttggtcatgtttcagtgagacagttaatctcagtgctttgcccgtttgatgcatgatgatggatgacatagtggtagaggagtgtgctagttgttaatatgttattcttttgcttgcaagacaattgtaactgatgatcatatggttctttgttcttcacccgcccaaaatctctaggcagtcaagcttcattcataattcaatttctgttgaaaaagatgtgattgtgacattgtgtagagagaaataaaccgctgtaaactctgttgttgcgatc

SEQ ID NO: 244 - DNA, 857 bp, Saccharum
taaacatttaactgcataaatttggtgataacatctgagatatagagatcatgtataaatgaaattagtcatttagtatccattatctgtttaggcaaactcagatgtctgaaaatttgggcaattccagtttcacatgaaattataaagtcgcgacccaaaccgataattatttgctagttgatttgttgtcctatggctgaattattcgctagttgattgtcctatggctgaattattcgctagttgatttgtctaatgtcctatggctgttcatgtggacttgtctgctactattattcttttattatcatttataagagcgtgtcacaaggtattatgaaagtttgatctttgtttcttggttatttgtcaagttatacattgtatcatagataaagattagctgtgtacctatttaatgtactggtgaatgcaagatgcttggttgcagtcgtttgattgtaattggcttgtatgatttattgttgtccgataaaagctgcatgaagacctactgctgtgccatattgagatcagctgctcaatcatggtggtgatgtagttgaagatcaacatcaactgcagtgcctgcatggtggcgacggagtattcatatgatgtgtgaaggtcaactgctcggtatacatttttggtatgaaattgctatgggcttccaagctttctttctcgatcactggacagggagaactgctctgctcaagcacgcttgtaggtcctagtctcactaggagcttactgaacttgcacgatattggttcatttcagtactcaatggttctgatgccttcttgatctctcttgagctgaagctaggtttaagtattggtgaaagc

SEQ ID NO: 245 - DNA, 854 bp, Saccharum
tgcccatgtggaggttccccagatcaatagtccactcctcataatccttgagtgtctcagttgggaacttgttgtccatcagagcatgtgccagtgcatcctcactcaaggcatgggacacccggccagggcggaagatgctgtgcccaaccgagtagcttcccacaatgacaggccctttgagaccaggatggccaagcatgccagtgcgggagtcactgttagagcaaacgctgctggcgatggatccgccatgcatgctggtctgcatgctgttgatgctatcagacatgttggagccctcccctagcttctggtagaaggccatgtcacagaagttcccgccaaagttcgcgccgttgtcattgccacccacagcgccaatgaagccagggaagttggcgccttgtgccatcactcgacaaccgaaatgttagcctctgcagtagcttcgctcttcccctggccccccaccacagctctcaaaaagcctggcgatggatgaccctttggaagatggccgggaagacgccgccgccgctgccgatgccagtcgatggaggaggacaggacgaggtcggacccgcgcggcgcgaaggtaccggtgcgatcgaggtcgagggaggacggacggacggtgggagcaggcggtggtgtgatgcggttgcgggtgcgggtgcgggtgcggcgtcgggagaggatggtcaggagcccctcgccgctggaccgaggaggccggggcgacgacgggggcggtgaccggtgggtggggggaggaaggcgaggggaatgtgagggcggaaaagatcaacaaaggcgaggcgagggcgaggcaggacagaagaaagaaagcg

SEQ ID NO: 246 - DNA, 1836 bp, Saccharum
aagaaataaattatccaacaatatatacagtgccataagaaacatatgaatgagttatctaccaagaattatgtccaacaatatgtacagttccgtcaaaaagcaacgtacagtggaactgtggaagtaacacctgggcatatttgtcacaaacaccgtcagccgggcagagtggcacaaaatcttcatcaatcgattccatcagcatagccacgatttaagcacaccatacccaatcagttggattagcacagccatccatcagcatagccatccatgatcaagaaacttttataagatcagattgaggagctccatgatcaagaaacttttataagatgatcaatagtggaatccatcatactgcaattttgcaaacctcaagtcctctacaagtccaacaattttgcaaccctcaagtcctctacacaagtccaacaattgctatggctcaacgaacatgcatgctaacaggattacaaaaaaaaacaaaatatccgaattgaccaacatttgataaatgataaataaatgaaaaatgaaatgaaatgctgatacataataacaataagatataggaatctggataaattaatccagtccaaaagcaattaggccagacaattgtagaaaatattatatacaaatgaaatagatgcgcaatgtcatcaggcaataaataagggtttacagataatatgagattaacgggctaaccggaaatataatttgcagatgcaacctaaatttttacacacttcttgaatggttaataacttttgcttcgttaagtttatgcgagccttcaattatagaacttaagctaagctgggcaaagtggaagttgacggtcaccaacgggtgttttaagatcttcagttcgatggatattcatgggtgtttcaggatttcttcgaatatgcaagcacagaatataggcgtcgtgtggaatagaaggaacgcgaagcaacttaaagattgttggaacttaattaacgattgtaccttgggattctcgctgtagcttcgctgtagatctccgtattagatgcaaaaatccgacgttgtgtagatctccgtgttagatgcaaaaatccggcatctagctgaccaagacgagcgagagggcgcaagcaacagaaggacagggacaccatgggggaggagaacccggggccaaaaaaaaatcaacccccgtgcgatctccttcccccggacacaataatcatctttttattattaccgtggcctgccatgcgagcgcacccatcatggcaaaggcctctatagcatgtcacatctttttttcccctctttttcccgtcgacgcacgcagactcgactcttacatgttgcaccttacctcgcctcttcaaggcggcagcacatctcttagatctactaataattatcgaaattcatccaataattatcagcgcagagacatcatcccgcgaggtggagcaggccaattgatcccgccgccgccgccttcagccatcgtcgccatagccccgctccgaacggaaccaccattaacgtcgccatttcgccagatcggtgccggatccaaggcttcatgcacgcgggaatcccccgtgctcagatccacacgctcccagctcgattcaagccgtagacgccgaaaatagcaatcagatctgggcctgcgcaacaacatgaagcaaacgggatttcccggtaaatcgaaacaaacgtagctcaccggcggcgcgcggggtaaccacgagccaaggtctcaaggacaccggcgatcctggatatggaggagaagaggaggttgcgtgcaggaggggaacgcgtcgaacaatggtt

SEQ ID NO: 247 - DNA, 832 bp, Saccharum
aaaacccaaaacgacacataattttggacaaagggagtacaagactgccggtactagcaaggctgtcagtactgagtgacaggccccgctaatcgcgtgggatgtccgtcattaggcagtcaatccggagggtaattttagttgactgaaactcgtaccagtggtgcactagtgcttagggagggggattcaggattcacatggcatgccaccctacctaggaatcctcactctccctgagtactagctcactcaggagcatgcaaatctggctcaggcattccagattcaggcatcagcaacggggcacctagtaaaatacctagcctagtgggggtagaaaacaatgcattccatattcggtgcagagcagggcaacaatggcggccgggactggtgtggatctacatctaggggcacttgggccctccttccttggtcttccagttgttgtagcaggggcaggcgcccttgttgccgtagaagcccggcggcacgcagaggcacttggcgcagcacttgttgcagaaggtgaggcaggccttcgcgtactgcgtctgcgagcaccgcgacgcgcacttgggcgagcactcccagggcttcaggttgccgccaccactggcgccgccgccgccgccgccgccgccgtagcctttcttccccttctgccgcggacctgcagacacggggaaggcgacggcggcgaggagcaggaatgcgagcaccaggatggagacgaccttgctcgccatcgctcgtcctggttggcctcctcctttgcctgagcctgaccaaagtccaaaggtgaggaagctgtggaaggcgagagata

SEQ ID NO: 248 - DNA, 1329 bp, Saccharum
tacaacggcggcggcagcgtcgtgggctcggagcgaagagagtggcggcgcgccgcggctgaaaggggcgaggtggttctcctacgatgagctcaagagaagcaccaacaacttcgccgaggcaaacgagctgggctacggagggtacggtaaggtttacaggggcatgctgccgacggggcagttcatcgccatcaagagggcgcagcaggggtccatgcagggcgggcacgagttcaagacggagatcgagctgctctcgcgcgtgcaccacaagaacctcgtcggcctcgtcggattctgcttcgagcagggggagcagatgctcgtctacgagttcatgtccggcggcacgctgcgcgacagcctcgccggcaagagcgggctgcatctcgactggaagaaacggctccgggtggcgctcggcgcggcgcgcgggctggcctacctccacgagctcgccgacccacctatcatccaccgcgacgtcaagtccagcaacatcctcatggacgagcacctcacggccaaggtcgccgacttcggcctctccaagctagtgtccgacagcgagaggggccacgtcagcacacaagtgaaaggaactttgggatatctggaccctgaatactacatgtctcagcaactgaccgagaagagcgacgtctacagcttcggcgtggtcatgctggagctgatcgtcgcgaagcagccgatcgagaagggcaagtacatcgtccgcgaggcaaagaggctgttcgacgccgacgacaccgagttctgcgggctcaaggacatggtagacgcaaggatcatgaacaccaaccatctcgcggcattcggcaagtttgttcagctggccctcagatgcgtcgacgaggtggccacggcccggccgtccatgagcgaggtcgtcaaggagatcgagatgatgctgcagagcgaggggctcagcagcgcctccacgtctgcctccacgtccgcgaccgaattcgacgtcacgaagggagctcctcctcgccacccgtacaatgatcctctcccgaaaaaggacaaggacgtgagcactgactcgttcgactacagcggagggtattctttccaatccaaggtcgaaccgaagtagctggtttctggattgagactatcttcttcgctcggccttttccttcttccccagcaagtggattgacgaatatgtagagatatggacaaccttttttattgtactttgcttaatctataagatggcaacagaggcgtgtttggaaaaaaaaaaaaaaaaaaaaaaaaaaaaaaacaaaaaaaaaaaaacggacgcgtgggtcg

SEQ ID NO: 249 - DNA, 1295 bp, Saccharum
cgcgctgggaaggggaaggggaaggggagccgaaccggacacgagcttggacttggaccacccccttcgcctccggaactcgtcaccgtccgtcgccaagcagcgagagagagatggcgcgcgtctccaatgccaagaagcggcagggcgccaagccggcctccgcgggcctcaccggcaccaacaccagcaccggcaccgccgccaccaagaggaaggccgaggacgaccgccccgtgcgcgtctacgccgacggcatcttcgatctcttccacttcggccacgcccgcgccctcgagcaggccaagatgctgttccccaacgcctatctcctcgtcggatgctgcaacgacgagctaaccaaccgctacaagggcaagaccgtcatgacccaggaagagcgatacgagtccctgcgacactgcaagtgggtcgatgaggtcattcctgatgcaccgtgggttctcacacaagagtttattgataagcatcagattgactatgttgctcatgatgcactgccttatgctgatactagcggagcagcaaatgatgtctatgaatttgttaaaaagatcggaaaattcaaggaaacaaaaaggacagatggggtttctacttcagatctcataatgaggatcttgaaggactataatcagtatgtcatgaggaatttagcacggggctactccaggaaggatcttggtgtgagctatgtcaaggagaaacaattgcaagttaatatgaagatcaataaactgcgggagactgtgaaggcgcatcaggaaaagttgcaaacagtggcgaagactgctggtttgaatcatgaagaatggcttgctaacgcagatcgctgggttgctggtttcctggagaagtttgagcaacactgccacaacatggaaactgccatcaaggatcggatacaagagaagctggggagacagttgagcaaaggaataatcgcaggtcttgtgcaggaaccggtgacagcctaaaacaggtgatgctgtcagtgaaacgcacggatgcttatcagatcatcctcccgaggtggttttggtgtgatcaaatggcatgcgatacttgtaagagtgcaacgcagttgctgaggcgttttagttttgtggtgcatgtgaagtcttcccgtatacaaatgtctataggagaggcgtttggtgttttgggcatcgtcgtgggcgtgtttctttgtatctaacgggttagattaaccttttcttatcgagattgatgttctttcgtggctatatatatcatattccatccaaaaaaaa

SEQ ID NO: 250 - DNA, 2367 bp, Saccharum
actggtaagttctctcttattaaatcagcatatagccaacttgtagcatgacagatacatacataggtatacagacgcaaaaaatgtcacccgttgaaccagccgattggagaccaaacaccgcggccatgcatttacacaatatctgcaaagaataaaggaatgcgcctccacgggaaattagcagcagtgtggcttgtccagaagactactctgaatcgtagaagtcgctagggcacggtgtaattacatccgactccagcatctgtaccaccctgtgcattgtcggccgcccctctgccaaagagctaacacattgcttggcaagagaaagcagagcatctaaggtctcagtctgcactccttcacagttcagatcgacaatttccctctcccggttctcaccagccagaaaatttaaccatccaacaatgtttaatcccttctcaatgaaggatgcatcggtaggccgctttccactaagtatttcaagtaccaaaaccccaaaactgtagacatcagtcttctcggtggctctgccaaattgcatgtactctggtgcaagataaccaaatgttcctgcaactattgtagtaatatgtgattcttcatcctctaaaagctttgcaagtccaaagtctgatacacgggcctcgaaattgccatcaagcaagatgttgcttgacttaatatcacgatgtattattcgaggcgaacagtcatgatgcaaataagacaagccttttgcagctccaagtataatgttaatacgtgcatcccaatccaactgttcagatttttcatgaagcacttcatccaggcttccacctggaagataatcatatatcaaaagttttgatgaaggagagttgcaataaccacgaagattgaccaaatagcgatgtttaacacttcccaatatctcaagttctctatcaaagaaccgatctagcccttcatttgttttcactattcttttcaaggcaaagacattgccatcatccattgcaagtttataaacagttccgaagcctcctgctccaatgatattttcttcatccatagtctctagcttcttgaggatgtcttttgaggagtaagggaggtccccatggaacatcacgacagaagagcctccacagagctccactctgaaaccacgcatatctttctttccaaaatttttgtaaagaaagcaaccccagaaacacattaaagccaccaataggagagctcccactgttgccactgcacttataacaagtctggtagaattcccattccttttattaatcatgtcatctggggaaggtgactgcagaccatttgatggtgattgaagtgcatctttgcacaccgagtttatctgcttcccacataaaacaagattcccaacaaaggatgtctcattgaaattgataagtgaaccagaagatggtattgctcctgtcaggaagttcatggaaacattgaatgatgtaagtttggacaacttatcaagagaatgtggaatagatccgctcaatgtattactggataagtccaatgcctcgagttccaccagatcaccaaattctgaagggatgtacccacttaaataatttccttgtagatacaattgttgcaacttggtacaattccctagttcaggagggagtgaaccatacaaactgttcccctgcagtgacaaggtttgcaactgatttaaccttccaatttctggtggtatgggcccaactaatctgtggtatgcaagaatcagattaatcactctcttgctatgactatcacatctaacacccttccaattgcaggggtctgcatcttgctcacgccaatttagaaagactccatctgaatttgtaactgccttcttgaaggcaagaagtgcttcgccatctgaactcagcgtccttgcctcatgagcaacaaggtgcagaattatcaaaatgaagaggtagctgggctgtttcctcaggaaagagcccattgataagcaggtggtgcagcatagaagatcagcacatactattacactttccagatgtcattgatgaagcatcttcaaaccagaaatggatttaacatgaggccacccactaagtggtcaaatagatttccaaccctgcgccgcgccgacgctggcaggaagcgccgcggcgatctgggacggggctcggcggcgaatgggggcggaagcagcgggccaggcgacgtcggccggcaacgggcggatgatgcggcagcggtgggcggcgtggcaaggcaaggggacgaaagggctggagagattaggcagccgctggccgctgctgtactgagtgaggcgtagagcagtgtactgggaattggactggtggtgtgccg

SEQ ID NO: 251 - DNA, 675 bp, Saccharum
ccctaactcatctcttgtgttgttcgccgcacacagcccgatcccgatcccgatccctcttctcgcgagcctcgtcgatccccccttccctcgcttcaagatgcagatctttgtgaagaccctcaccggcaagactatcaccctcgaggtggagtcttctgacaccattgacaacgtcaaggctaagatccaggacaaggagggcattcccccggaccagcagcgtctgatcttcgccggcaagcagctggaggatggccgcacccttgcagactacaacatccagaaggagagcaccctccacctggtgctgcgcctcaggggaggaatgcagatctttgtgaagaccttgactggcaagaccataacactggaggttgagagctccgacaccatcgacaacgtgaaggccaagatccaggacaaggaggggatcccccggaccagcagcgtctcatcttcgccggcaagcagctggaggacgggcgcactcttgctgattacaacatccagaaggagagcaccctccacttggtgctgcgcctcaggggaggcatgcagatctttgtgaagacccttactggccagacgatcacccttggagtggagtcctctgacaccatcgacaacgtcaagggcaagattcaggacaagggagggcattccttcggacca

SEQ ID NO: 252 - DNA, 733 bp, Saccharum
gggggacaacaatcagctcggacacagattgtttatacaaccaacatataatagtagcactaacaatagcagttcatcaaattacaagtccttgacacagctaggctgattttacaacatacggagtactactacttaattaatatcacatcacaccgtgctgttcttacaacctgtagagcagcaccatcttctagcaagaaacagctaccagaacaatggacacctgaacggccggggtcactgaccagtgaccgaccgaccgaccaccggagacgccggacacaaaaacgccggcttcccatcggttcggttgtggttctctcctccgggaaccaaaccctaaataacataagagatctacaactgactgaccggtgacagcaacaaaaacgaattgaacatctacacaaaacgaacgaacgggattagcactaataatccactagtgcccgcgcaggatgtctaaaatcccatctgcgcgacggccgttaaccttaaccctctgctgcagcctgcagtagtcgtcggaaggagccaagaagaacaacaatgtcggtcggtggttaattggcggcgaggagggagtcccagtcgatctcgtacgacgggtacttggtgagcgcgaagccggcggcctcgtcccacggcgcctcgctgaagtccagctgctgcatctccggcaccgtcgacgactcgggggagcggacggcgacggggacgggcacgagga

SEQ ID NO: 253 - DNA, 1215 bp, Saccharum
ctgtctcttcgcgcacccccaattcgaacgccggagctcgacgaggtcgacgcacgcagagatccggcgtactgcaagttttgaaaactgaattgtaagatggcatcagcagagctttcccgtgaggaaaatgtgtacatggccaagcttgcggagcaggcagagaggtacgaggagatggttgagttcatggagaaggtagccaagactgttgactctgaggagctcactgtggaggagcgcaacctcctgtctgttgcatacaagaacgtcattggagcccgccgtgcctcatggcgcatcatctcctccattgagcagaaggaggagggccgaggcaatgaggaccgtgtaacactcatcaaggactaccgtggcaagattgagactgagctcaccaagatctgcgatggcattctcaagctgctcgagtcccaccttgtgccctcttcaactgctcccgagtccaaggtcttctacctcaagatgaagggtgactactacagataccttgctgagttcaagactggagctgagagaaaggacgctgctgagaacaccatggtggcatacaaggctgcccaggatattgctttggctgagcttgctccaactcaccctattaggcttggactggcacttaacttctcagtgttctactatgagattctcaactcacctgatcgtgcctgcagtcttgcaaagcaggcttttgatgaggccatctcggaactggacaccctgagcgaggagtcctacaaggacagcactttgatcatgcagctcctccgtgataacttgaccctatggacttctgacatctcggaggaccctgctgaagagatcagggaggcgcccaagcgcgactcgagcgaggggcagtaaagccggctttacgtgcctagaaactagtagcttagtgtttgctgctgtctaatgacactatgcaatgtgatctggaccctggtttcttggtgcttgtagccgtgttatgattattgtcgggaaaatttgggggctccccatatgagatgctgccgggcaaggcctcggtgtcccacctcgtttcaggcaggggcactggagccaggtttggttggttgggttgggaagccctttaagctgttgtcacttgcattttaccttttcatcgccgtttattgtgagtggtcctaaatcaatggctggtctcagtggtctatgttttttggttct

SEQ ID NO: 254 - DNA, 1309 bp, Saccharum
aaaacatatgaaggatttttacattcaataaatagagatcaaggcggtaatctacttgacattccttaatacatctcaaaacacaccagattcaaaatatccagttgaatgacaaaaatgcagagagagaatgagagtacaggcgttcataaaaggaatgagcgacagagcaactcagctcatacaaatgccaatgcaacgtcaggaacatttagcatttcactgtaccatctcaaggtccttgaagtactcatgctcaagtgcttgcctagctgtgattcttttgcttggctcatatcgaagcattttcgagagaaggtccaaaccagcaggttcaagatttgggacaattgttgccaggtcctgagcctgccacctggggaaagcagtcttgaagtcaggcaaacaactgactcctggccaactttgttcatttggtgtacctagtaccctgaatatcttaaacagttcgtcgatctcagaatcaccagggaatagtggcttttggttcaccatttccgcaaagatacagcccacagaccatacatcgactggtgtggaatactgtttcgctccaagcagaatttctggagctctgtaccataatgtcactacctcatgagtgaatgtacggacaggaattccaaatgccctggataaaccaaagtctgcaagcttcagtgtattagtacgccgatctatcaataagttctgaggtttcaaatctcgatgaagaaatctatgagaatggcagtaagcaacaccacggagtatctggtagaggtatgacttaatcaaagtgggattcttagcaaactccgggcaagagtccatgaacttcttcaggtccagatccaggaactcaaagacaagatatatgcgcttctcgctgtggataacatcatgtaacctgacgatgttgtcgtggttcatctccttgaggagagagatctcgcggatggcggtggaagggacgccctcgtcctcctgctcgaggcggatcttcttgagcgcgatcgtctcgttggtggccttgtccagccccttgtacaccaccccgtacgtgccctccccgatcttctcctgcttctcgtactgctccattgcgtcccccaatgcggcgacggctgcggaacgaaccaactggcgaggaagcgggagggggttgggggagaaatggaaggggattaggaggagagggagaggaggtggggaaaggcggcggcgggcgaagctgcagctgccattgaggacgcgtctccgccggggctgctgggtgctggcctggtcctcgtcctccactcctcgc

SEQ ID NO: 255 - DNA, 801 bp, Saccharum
ctgtcagtcctcggttcgcgagtcttccacaggagcagggctcgcttcttctcccatctcctaatttcatctcgcgccgggggtcgcctgagatcacagagacgatggtgaaggcggttgctgtcctcgctggccctgatgtcaagggcaccatcttcttttcccaagagggagatggtccgaccaccgtgactggaagtatctctggcctcaagccggggctccatgggttccatgtgcacgcgcttggtgacaccaccaacggctgcatgtccactgggccacacttcaatcctgctggtaaggagcatggcgcaccagaagatgagaaccgccatgcgggtgatcttgggaatgtgacagcgggagaggatggtgttgttaatgtcaatattactgacagccagatccctctcactgggccacactcgatcattggccgagctgtagttgtccatgctgatcctgatgaccttggcaagggtggacatgagcttagcaagagcactggaaatgctggcggacgtgttgcctgtggtatcattgggctccaaggctagatgttatcctccgaggcaaaaggcaaaatattatggaagcgagcaccttaggagttgctgttctatttcccttgtattggctccacaatttggttactccaaataagcgcctgatgcatgattagagcactattcatgtcattttgtatatgaacaatattgcacatctgcttaagtgtctgctccaacaaatgcttgttgattaaaaaaaaaaaaaaaaaaactcgaggggggcccgtac

SEQ ID NO: 256 - DNA, 3233 bp, Saccharum
aagggttgctctgaagcggaggggaagcaggctggcattgctgctgggagcatggtgaggtgctaaggaggagcagctcccgcagtctggtcattcttgccggccgcaccttggtgttcttgtccaaggtcgtactggtggtgggagatgaacctctccccgcccaagatgtcggagccatcccctgaaagtgacggggaacaaaggtgtctgaactcagagctatggcatgcatgcgcagggccccttgtgtccctgcctgtggttgggagccgggtcgtctactttcctcagggccatagtgagcaggttgctgcatcaactaataaagaagttgatgctcagatcccaaactacccaaacctacctccacagttaatctgccagcttcataatgtcacaatgcatgctgatgcggagactgaagaggtgtatgcccaaatgacactgcaaccattgagcccggaagaacaaaaggaaccttttcttccaatcgaattgggtgctggtagcaagcagccaactaattacttctgcaagacgttgactgcaagtgatacaagtacccatggtggtttctctgttccacgtcgagcagctgagaaagtcttccccccattggatttttcacaacagcctccagtgcaagagctggttgcaagagatctgcatgataatgaatggaaatttcgccacatttttcgtggtcagccaaaaaggcatctattgacgactggttggagtgtttttgtaagcgcgaaaagactagtagcaggggattctatcatatttatctggaatgataataaccaacttctcttgggaattcgtcgcgcaaatcgtccacagactgtaatgccctcttctgtgctatcaagtgatagcatgcacattggtcttcttgctgcagcagctcatgctgcagccacaaacagtcgtttcactattttctacaacccccgggctagcccttctgagtttgtcattccactggctaagtatgtgaaagctgtttaccacacgcgtgtgtctgttggaatgcggtttcggatgctttttgagacagaggaatcaagtgtcagacgatacatgggtacgataacaggcataagtgatctggactcagagcgttggccaaactcacactggcgttctgtgaaggttggttgggatgagtctacagcttgataaacagccaagagtttcactgtgggagattgagccactgacgacctttccgatgtacccaactgcctttccattaaggctaaagcgcccgtgggcttcaggactacctatgttcaatggtgggaggagcgatgagttcgctcgttattcttctctcatgtggcttcgagatggaaacagaggggttcagtcactgaacttccaggggcttggagcatcaccatggcttcagccaagaatagattatccattgttgggtctgaagccagatacttaccagcagatggctgctgccgcactggaagaaattagagttggggatcatttgaagcagacatcttctctcctgccagtccaacagactcaaaatttgaatggtggattagatcctttgtatggaaatcctgttctacagcagatgcagttccaatctcagcagtcacccctgcaagctgtgcagcaaggttatggtcagaatgcaagcgactctgggttccttcaaaatcagctgcagcagctgcagctgcaaaagcagcaggagccaccaccacagcagcagcagcagacacaagttctgcagcaacaatcacaccaggaaatgcaacagcacctctcagctagttgtcatgatattgctaatgtagcttctggtgtgtccgagtctggttctgcttgtcaatcacaatcctctttgctttctgggtcatcgttctaccaacagaacatctttgatggaaacaatggtccagatctgcatctgcacaacagtttccacaacttttcgagccaagagtcctccaaccttcttaatctcccaagaagtggccaattgatggcatcagagggatggccttcaaagaggttggctgtggaatctcttgctagtcatgagctccaacctgtgcagctcaagcttgagaaagtgaatcaccagagtaatgtatctcatgtttctggcaccttgccgccactgtcaacaagagacggttctagtgcccaggcttgtggtacaaatgttcagagtcacctgctttcatcatcatttgcaatccatgatggcttgtcaaccgtcaggagtggtggtgttggcaatggaactgatgcgacaaccatagcttcgttgagatatggtgatatgaatttgctacctgaaaactccatagcaacttccagttgtttgggtgaatcaggaaccttcaattctcttgacgatgtttgtggtgtaaacccatcacaaggtggaaccttcgtgaaggtttacaaatcagggtccctcgggagatcgctcgatatcaccagattcagcagctactacgagttacgtagcgagctcgagcggttatttggtcttgaaggccaactggaggaccctgtaagatcaggctggcagcttgtattcgtcgaccgggaaaatgatattcttctcgtcggcgacgacccgtggcaggagtttgtgaatagcgtatggtgcataaagatcctctcgccacaagatgtgcagcagatggtccgcggcggaggcgaccttctgtcaacacctggagcgaggatgctgcagagcagtgtctgcgatgactattctgcaggccacgacatgcagaacctcaccggcagcattgcacctgtggtgcctctggactactgagactgagatgaagactggaatctgaagttctgaaccaaaaccagcaattcagcaccggaggattgccatccacaagtcgtttcagttcctatgatcttctctcaagtcctgttggtcagaaataacctagtcgttaatatagctagacgatccattgtatcattatggtaatggacatgttgtacgatagctactgtagctatgtgatagccatagcctaagctctaaatggcaggcaagaattgatctatgaaattatgaatgcaggcactcactgtagaggtgacctagccctgtagttctctattatcttctcatatctaaaactgatggttccatgtggcgcccaaactattgaaacctgtcagtgtcacctatgtcaattttttttgttctcctc

SEQ ID NO: 257 - DNA, 840 bp, Saccharum
gaacataagaacatgatgttttacttctgtagagctacagaatttcacaacagcacacttacatattaactagcaactagcaaatgcatcacgctttgatccagaattggtatcagttcactgcaaactgcaagttgacaaattatcaacgacaaacagtgttccaaaagcacaaccacagttcttacagcaacccagcaactgacctacacatcatttcgagttcggactactgatacagctagcactaccagatgaaatgagccacatataccaacaccacccagtaccaccaacctaatctaagaagaggtgaacttggtcacagccttcgtgccctcggagacggcgtgcttggcgagctcgccggggaggacgaggcgcaccgacgtctggatctccctggaggtgatggtgggcttcttgttgtagcgggcgagcttggcggcctcgccggcgagcttctcgaagatgtcgttgatgaaggagttcatgatggacatggccttggaggagatgccgatgtcggggtggacctgcttcagcaccttgaagatgtagatcttgtaggtctccacggacttcttggccttcttcttgcccttcttgtcgccgccctccttgccggccgacttgcccgccgggaggcgcttctccgccttgggcttcttccccgccggggccttctcggccgcgggctcctcctccgcgggcttcttcgccgccggcttcttctccgccttaggtgccatcgatgcggcttgctgttgcgtgaggcttcagggaacgtggggattcgctcgctcggtcggtttgaggacgggaaatcccacgcgtccg

SEQ ID NO: 258 - DNA, 1508 bp, Saccharum
cctcgccctcctctcctctgcgttttgtgccgtcgccatttgcgatttctttggaggaaaaagggaagcgagcgagcgcggaaaatactccacagataccactcacctaccgctcctccaatccgtcgtccaccaagcacaagaagctttgcatatctccctcgtccttccctttccttttctccctcctccgtccgcacagcgcacgcgcaggcaggaggccgccgcccgccaggagctccgtctctatcgctctccgctggatcctccggcctctcgcggtccggtggagcggagatccggccgctcgggcgtcggctgcttcgtcgttctgccggagcaagaagctggcatcccgccatgtcgtcaccgatgccctcccctactctgaaggatcatctctccacgcctacaggccccttgcatctcaaaatatgggaggtcatatgcattgccttgggggctttcatggtgctcgtcttgtttgtcaccgtgtggctcacgatcaggagcaagaagagggtaaggcggcgtgcatccgcaaatatcccgatcacccaaatccctgcaatttccaaggaaatcaaggaggtgagggtggagcaagtgccggcaagcgactttgtggcgcatgatggcgtcctcctgacgatccaggacaagtccagcgaccgggattcggacaaggtcatggcccatttgggtgttagcaaatcgaggcgtggtgatgagagccattcggggtcatttcgctacatggacaaggatgcgggattccagtcagctgaggaaggcggctctggaacgtttcggcaggcttcagctaatgccataactgctccttcacctctggttggcttgcccgagttttcataccttggttggggtcactggttcacgctgagggatctggagcttgctaccaatcgcttttcaaaggacaacattatcggtgagggtggatatggtgtagtttatcgtggccagctgatcaatggctctcctgttgctgtcaaaaagcttctcaataacctaggtcaagctgagaaggaattcagagtagaagttgaggctattggtcatgttcgacacaagaacttggtccggcttcttggttattgcgtggagggtacccaaaggatgcttgtctatgagtatgtgaacaatggaaacctagagcaatggcttcatggagctatgagtcaacgtggctcccttacatgggaggcccgcataaagattcttcttgggactgctaaagcgcttgcttacttgcatgaggcgattgaacccaaagttgtgcaccgtgatatcaaatccagcaatattttgattgatgatgagttcgagtccaaagtatcagattttggtctagccaagcttcttggtgctggaaagagtcatgtcaccactagggttatgggtacctttgggtatgtggcgccagagtatgcaaacactggactcttgaacgaaaagagtgacatttacagctttggagttgttct

SEQ ID NO: 259 - DNA, 2197 bp, Saccharum
ctcatacagtaaaatactagttgggtcaatagcagcggtacaattacaatacaagccaacagatgtatagtcattacaatactggagaagaagtacaaggcaaggcagaatatctagtatgaaacaattctcttacttctggttcataacttgagagaacatcaacagcacgaactcatgaactgaattaataaattatgcctgcaaggtaacgaatgggaccagctttacctcaccgccccttggggttcatgatctgtgagaagacagcgctaggcgtcagcccatccgagtccatactcgcgacactttgatcgcccatgcttatagaagtggtggttgtggtggtggtgcttgattcgatcgatgggtcatttggatccttctttccgaccatcacaaggggagtgccctcgtccgacatcccacaaccaaggcttccgctctcttctgcgctttcctgcatctgaagggcaaactccaagttccagagcacatcacccatcgaagggcggtcaataccctgatcagaaacacacttctcagctgtctcagcaaacttcttgaagcattgtggagctatctttcccttcaggtaggggtcaacaatctgatcaagaatgcccttcttctggcagtgcaacgcccactccgccaagctaacttcttcttttggaagagtagggttcagggcaggccgtgcacagaggacctcaaacagcacaacaccaaaagagtagacatcagatttctctgtgagctgctgcctgcggaagtactcaggatcaaggtaaccaaaactgcctttgacaactgtgctcacatgagtatggtccatagatgggccagtcttggacagaccaaaatctgaaaccttggcaacccatttctcatccaggaggatgtttgttgtcttcacatcacggtggatgatggtgtgcttggcaccagtgtgaaggtagtgaagcccacgagctgcaccaatgcagatatccaaacgctgcctccaggtaagaggtggcttctgggtcttgtacaggtgctcgcggagagtaccatgagccatgtaatcatacaccaggatcatttcattcttctcctcgcagtacccaatcagtgacaccagatgacggtggcggagcttggacagcatttcaatctcggtttggaactcatgcacaccctgctcagacaagggattgccacgcttgatagccaccttagttgttcccccatcaatctcaccacggtaaactttaccaaatccacccacaccaagaataagggactcatcaaagttgtttgttgcggccttgatctcagcgaaagagaaatggcggcacaggttggatggcaaagatgaagcatagctaccagtagtgtgtgacttggctgaactggaagtgtgtgaattgccataaagagacaggggcagccaaccagaatgtccatcgctcatgcctgcatccttcccagcattcctcctacgcttgcagatcacagagaagcagcaatacccaagtgcaagaaccaccaaacctccaaccactccaccgacgataggcccaacagttgacttcttcttagttgtcccatcattcgccggggcaacacttgggataggattgagccctgcaaggctaccattgataagctgtaacttgaagacctccatgccattgaggatagcatcatatatttgtggtttgttgtcaggatccggatgtagagctatccataaatccataggccctaaacccggtgtgctcaccacatagtcttgatacaccggagtgccaataagggtggtagcaccactcatggccgcccacgcattcacatcagcacccttgactgcagtctggttgttaatgtaaattttgaagacccgctgattgatcttcgtgatcgggtactggatctcacagaaatgcagcctgataaggtacatgaatccagcatccacctgcaacatccatgtgagattggagttcatgttcacttccttagttggccccatggaacgtgctgtgccgtagacatcctctggcgccacatactccggcacattgcttggatatgtgatggtgacattgttatccttcgggtagctgaccccgaagctagcgccaaagatgtaggttgagtcgtcgtcccaggaccggtaaccgcccgtgtccttggagggcgaaatcgc

SEQ ID NO: 260 - DNA, 937 bp, Saccharum
caggggtccatcaaacaaacattcctataatttttgtacataagcaggatccttttaattcatgagaagcataggtcaacaacaaccgctacattacgacaggcagccaccaccatgagcaaccggggctcttgatcggggcaaaaccacgacgacgacagacagactagaaaccaatcactggggttcttcaatgtttcgacaagcctggcgaaccagaaacacaaggaggttttttttcttcacgatttcttattgtgccctttcgggcacgatgagcatcctcctgcactagtcggctgtccagctctgctccacaatctcgcggactttgcggttgtactcccgcttgttctcgctgaacagtcttgcagcttctgagtttgcaggggagtttgggtttggatcgcacagcagggactgaatagaagtcaaaattgcagcaacatcatatataggactccactggttctgtaggatatccaagcatatgcttccatcagcatatatatttgggtgaaacatcctagagacaaatcgaacagttggtggcttgttcgggtaatcttctgtaaactgcaaagtaagcttgaacgtgcctccgtcccacggcgtatcatccggcccgaatatgacggcgttccagagcatgatgttgttgtcgtgcggcgcgccgctgatcccggcgggcgggtcctgctgcaggcgcttgaagtcccgcatcagccgcttcctcgccggcgtcgacatctcggccgccgccgcagcccggcgccctcaaaccctaggctagggtttcgatctccggcagaacgctagctgcgtccgtcccccctctggctggctccttgaccccgcgaggttgcgtctgaaatcagagaagcttcgagacagagagaggaaaggaaggaaggggtgatgggtgggggtggtacgc

SEQ ID NO: 261 - DNA, 946 bp, Saccharum
gggtgggttggcttctcctccccctcaggttcgggttcgggttcgtcaggttctccggttcgggttcgggttcgtgggtgagcggaacgagatggcggcgtcggacgttgagtaccgctgcttcgtcggcggcctcgcctgggccaccgacgacaactccctccacaccgccttcagcacctacggcgaggtcctcgagtccaagatcatcctggatcgggagacgcagaggtcccgcggcttcggcttcgtcaccttctcgacggaggaggcgatgcggagcgccatcgagggcatgaacggcaaggagctcgacggccgcaacatcaccgtcaacgaggcccagtcccgcggcggcccgcgctccgccgggggtggcggcggctacggcggcgcccgtggaggcggtggcggctacggccgccgtgatggaggtggctacggcggtggcggcggcggttacggcggcggtggctacggcggccgtggcggtggtggctacggcggcggtggctacggcggcggcggcggcggcggctacggcggtggcagccgcggtggcggcggctacggcaactccgaggggaactggaggaactgagcggtggggcccgcgcggccaagttatcttgttcgctactgctaccgtgtcgctgtgttaccctagtccagagcggggtttatcttgttcgtcgttgtcgtcgtgtctgtgtgttcgtgtttttgttgttgttgcccatctgtgtttttgatcgcaagctcgctccttcgatgatgttgttagtgctgtgttcgtcctcgtcttcggccccgggcatcaatcagcatgaactggcctgggatcgatgcatgtttacccctgtcaagttgtttatcatcagtcaatcaatgaaaaaaaaggtgcttcttggtgctgcaaaaaaaaaaaaaaaaagggcggccgctc

SEQ ID NO: 262 - DNA, 892 bp, Saccharum
cgttctgcttcctccctagacgcacttcccctctctcgaactctctcgtccggttactgtttgagggaggcgaaagcgggcgattcggtctccgccggggcggccggcggtcttcctcgcctccgatggcccttaggccttcgcgaggtggtggagaccactggtcttgtcccggtcggggttgtaggtcctagcaggtctaggtcttggtgtccggcggcggcgttgaggcggcggcggcggcgtcgtcaaggaataaggtactctcgcgctctcccccgtctcggtggtgctctgctccggtgccgtcgacgagcgcgtggaggtcgtctgtacaggagtccttgcgggttgcggttccatcgcctcttggaggtggtggtgccgatagcgcgcatcgtcaaaggtacatcgacagttgtgggtgttgcggttggttggggagaggatcgagctcagatttcccgtggcgcttgtcgacggcgagcattgatccttggtcggagaagctcggggtgcgtccccggccgatgcgccttcatcgacgtcttcatcccgtcctcagggacgggtgactattgcggctcgtttgaaagcaatcttgcgatggggcttctccagatctgcggcggccatgatgtcttcttcgacggcggcgaccggcgacggatcgacgatggcggtcgttggaggcttctggcgatttggggaatcacagggtccagggtcctcaatgaaatttatgtttttcttaggggcctttgtgtaagatggtgggcacagctgtccatgtatccttttcatatgtacctgtattcgtacgtatatttgtacgtccttgtctaagtaatacaggtatgttttctcaaaaaaaaaaacctccagcgttctt

SEQ ID NO: 263 - DNA, 666 bp, Saccharum
cccagcatactacattcacttgcattgaggaatgacaggttgcaaaacaagctttgatttccaacatctgatgttcacatgatttcgatactgcatgattcaggtaaacctgctacagtcttacaattcagataaacctactacagccagagatgaactacaaagagttcctgaaactttcttgaccgcaagacttgttggcacggccagacaacatcgcagctgcagaagggggaacatcgaggggagcccaccagcctagccgccgaagccgtagagggtgcggccctggcgcttgagcgcgtagacgacgtccatggcggtgacggtcttgcggcgggcgtgctcggtgtaggtgacggcgtcgcggatgacgttctcgaggaagatcttgagcacgccgcgggtctcctcgtagatgagccccgagatgcgcttcacgccgcccctcctcgccagccgccggatcgccggcttggtgatgccctggatgttgtcgcgcagcaccttccggtgacgcttcgcgccgcccttgccgagccccttgccgcccttgccgcgcccagacatggcttcttccgctcgggtgggtgatgggtttcctcggagtagtagactgcaggcggcgggaccgaaggtgagattggtggtgctcggacgcgtggg

SEQ ID NO: 264 - DNA, 631 bp, Saccharum
tttttttttttttttttttttttttttttttttttttttttttttttttttttttttttttttttgaggctagaaccgagggttttccattgataatgacaactagatattacagcaacacccaaagcgtagatagagcacaaccaccacagaacacagcaccgatacagagagcacagactacactagacacggcacacaacacgaccacctccgccaccacatgcagttcgccaccggatgaggaatgacctagccgccgaagccgtagagggtgcggccctggcgcttgagcgcgtagacgacgtccatggcggtgacggtcttgcggcgggcgtgctcggtgtaggtgacggcgtcgcggatgacgttctcgaggaagatcttgagcacgccgcgggtctcctcgtagatgagcccggagatgcgcttgacgccgcccctcctcgccagcctccggatcgcgggcttggtgatgccctggatgttgtcgcgcagcaccttgcggtggcgcttggcgccgcccttgcccagccccttgccgcccttgccgcgccccgacatcgccgaaaccgagagcttcgctgctggaacttggaatgcggatcaggaggaagcgaggaagaggagg

SEQ ID NO: 265 - DNA, 877 bp, Saccharum
ttttttttttttttttttttttttttttttttttttttttttttttttttacaaagcacatcaaaagataggttgttctcaaaaccgacatgtaacacatactcaggcgatccagcacaatccaacacagttcagttcatcggttgctacaggtgcttaatgacaaatacactgatcatagatcaggtgctcttatttcacgatgtctcggaatgttcaggctggtctgttggcgacggcacgagacgacacactcaggcacccgaagtccagcgatcattttcagccctggagtccaatgatcccacaagcaacacggccaccagcatttccagtgctcttgctgagctcgtgaccaccctttccaaggtcatcaggatcagcgtgaacaacaacagctctgccaatgattgagtttggcccagtcagtgggatctggctgtcggtaacactgatgttagcaacaccatctgctccagctgtcacatttccaagatcaccggcatggcggttctcatcttcaggtgctccatgctccttgctcgcaggattgtagtgtggtccagttgagatgcagccattggtggtgtcaccaagagcatgcacatggaacccatggaggccaggcttgaggccagagacacttccggtgacagtggtagggccatctccctcttgggtgaagaagatggtgcccttgacaccctcgctgctaccaagcacagcaacagccttcaccattgtttatgtgatctcaggcgacccccgcggcgaggaaggagacggacggccttggagtcttgcgcttctggaaggttctctcccgagactgggggtagttgggggatttgcgggtgcggggaggatgagaaggacg

SEQ ID NO: 266 - DNA, 932 bp, Saccharum
aaccaaatacatcagcacatccttccctcatgtcacaattgtgacaaatatctaaaatacaccaatgttccaacacaatccccaccaaaatccaagcatttcatcagggatttacaaccaaaacaatattgcgtgaatatttcgaacacacccaacaccaaacatagaagcatcacatggaactgcagcacttgctctttgggatttcctgtgccggacctgggacaaggaccttcgtccctggcattgctggggcagctccattgctctttggctccgacaccatgttcttcttgctgtgaattttgaagatctctgtcaagacagtttgaaaagcactctctacgtttgttgcctggagcgcagaggtctctaggaagaagagattctccttctcggcaaactccttggcatcttcagtgctcacggctcgctgctcctcgagatcactcttgttgccaaccagcattatcacaatgttcttgtcagcatgggctcggagttcatctagccagcggggtatatgatcgaagctctggcgtctagtgatgtcatagaccagcaaagctcccagtgcacctctgtaataagcgcttgtcacagctctgtacctctcctggccggcggtgtcccagatctgggccttgacgctcctgtggtcgatgacgagggtgcgggtctggaactcgacgccgatggtggccttggaatcgaggctgaactcgttgcgggcgaagcgggcgaggatctgcgacttgcccaccgccgagtcgccgatcagcaccaccttgaagacgtagtccaccttgtccccggcccccgccatgcctcctcggtgccggtggcgggctggctagtggcgctctctgctccggcttccttcggggctcgcgaaggagagaagaggcagctgcgctagtgcggacgcgtgg

SEQ ID NO: 267 - DNA, 1099 bp, Saccharum
caaccactcgtctctttttcttcgccccgcccgaaagccgaagccgaggagaagaggggagcagcgagatcgcgcgcgcctccgagatctccacgaagttgtggcaacatggggctcaccttcacgaagctcttcagtcggctcttctccaagaaagagatgaggatccttatggttggtctcgatgcagctggtaagaccaccatcctctacaagctcaagctcggagagatcgtgaccaccatccctacaatcgggtttaatgtggagactgttgaatacaagaacattagcttcactgtctgggatgtcgggggtcaggacaagatcaggccattgtggaggcactatttccagaacacccaaggccttatctttgttgttgatagcaatgacagagatcgtgttgttgaggcaagggatgagctccacaggatgctgaacgaggatgagttgagggatgctgtcttgctcgtttttgctaacaagcaagatctgccaaatgcaatgaatgctgctgagatcaccgataagcttggtctccattccctgcgccaacgccactggtatatccagagcacttgtgctaccacaggagaaggtttgtacgagggtcttgactggctctccaacaacattgcaaacaaggcctgattggacaattctgtggtttcacggagcacatggcgcggcattttctgcagaaacggagccatggtcattttgaccctgagacttgattggccctattcgtttcgctgaaatttggctgatgctgctgcttatgctgatttgttgctgagagaaaaacatttgttgtttcattggaatgttaaatattgtatttctttgctaggcttttcagagagctggtttgttatgttgcgtgattactctctaagaacctgttccgatatcaagacagtgtaattggccattggcactagtagatcgtttactgagtaatgcagtttatatgaatgtatcgcaattgtgctgtaccataacttcacattcttgtttgtgtgtgtcggactttccagttaaatctggagggatgttaacgataacgagtcgcattgtgggtatagttccatat

SEQ ID NO: 268 - DNA, 735 bp, Saccharum
aattgtgccttgctatgttgaatgccacataatttgtcaagaacgattacaaacagaaaacgtccaagagttgacacctcaaaatttcaatcaatacagttccaaaaacttcctcagtaggagtatattagacgctggcagacttgaattgctacatctgacagggccaccgcgacaggacttgaaattacagcctccttcctctcctaccaccctttctgcgagtgctgtcagtggggactggagtaacatcctcaatccggccaatcttcatgccagatcgagcaagggctctaagagcagactgagcaccagggccaggggttttggtcttgtttccaccagtagcacggagtttaatgtgcaatgcagtaattccaagctccttgcatctttgtgcaacatcctgtgaggcaagcatagcagcataaggtgaggactcatcacgatcagctttaaccttcatgccaccagtgatgcggactagcgtctcccttccggacagatctgtcacatggatgaatgtgtcattgaatgacgcgaagatgtgggcgacgccgaagacatgctcgccctcacggacggcggggccaagcgtcacattctcttccttgggctcacgcgtcttcttcctcccagacatggcggcgacggctgcaaaagagggggcggctcgacggacggcgggaccgagaggagggcgcagcggcggcgggcgctggagaggagatgctg

SEQ ID NO: 269 - DNA, 691 bp, Saccharum
tgggttacatgttcttggggcaaagcataataatgccagtccaaaccggaaatgtcgaatcacatctcaaggaataatccggttggagagcaagcaatgcggcggcggagggaggtggaacaagcaaggatcacacgctaaaaaacccagatccccttgctcttccgttctcgggagtagctaatgacaaactatatgtacacacagaggcaggcgctgcggcggcggcggcgccgcccaccggcgagcttgctgcgcgcgcatcacccgctaggcggagcgcgcgaggcgggacgcgatggcggagtggtacatggcgtcgtggaacgactccgtctgcgccatccgcgcccgcagctcccgggccttctcctccgtcatcacccccacgaactgcctccgtgccgcctcgtcctgcgcctgcagcgccggtaccggcgccggggcctccaggtagtcggcctttcccgaccaccccagcagcggcgcccaccacttgccgttaccgccctgagccgcggaggcgcggaccgccccgaccccggcgcccgcggcggcgcggggccgggccgaggacgccgccgccgggcgggccgggaacgggaacgagacagcgctgcatgctgcggacggtgccatcgccattggattcgggggttgttgcttcaatgcttcttcgattgctttggtt

SEQ ID NO: 270 - DNA, 2054 bp, Saccharum
cacaccgaacacctgagtttattcattacagagaggttatttgttcagttttgtgtttacatccatctaagagaatgataaacatcaggatttcaacaatagagccacacgcttaaagatgcaacaagttacagatttgacgaagggggaatgcttagctaggcagctaacaggcagaagttgcagcatgcacccacagtgaagcaaataacagaatcctaataaacaatagaaacacccctacaaagctgccgtgcgtacagcagaacttacaccgaacaaatgctaacaaacatgtgaaaacaatcgaatcaacaagaagcaagcatctaagagactgcagccacaatcttagttgtccacgacaagcttccgcctcttgtaattaaccatcacctcacccttgatgccaaccaccatggcgttccagtcgttctctgggaacggcgacaccagctcgaactcgaagttcctcagtaggtgcgtccagatcgccttgatctgcaggtaggcaaagggctcaccgaggcacccatgcctgccgccaccaaaggagatgtatgagaaggcgcctgcagccttgtcctcctcccttccaggaccgaaccggtcagggtcatatgagtcagggttcttgtagatgtggggcagtctgttggcaaaggatggcgatgtcgcaacaatgtggcccttggggatgtcatactctttgccttcctttgttgtcacggtgaagtcgctgtgtgattggcgaagcaacatgattagtggcgggtggagacgaagggcctctttgatgcaccggtagaggacatccatctctgccaggatgtcatgatcaatcttgtcgccatggcgtttcatgacatccttctgctcctctacagcttctgcaaagtactgcttgaaccgaagcatgtacgctccagtccaggttgaggtgatcgagctggtgtgctgtccagcaaagagtgctgcgataagtagcccggttacctcaccctcggtggtggggcgcccattcttgtacttggaatcaatgaagcactgcagcatgtcttcctcagactgtccagaggccttgcgggacttgatgatggtggcaaagatttctgccaaacgtgcccgtgccctgtcacggcgcttatgtgcagggattgggaggtatgggaagaggacactgattggctgcatcccgttgtcaaggtcatggaagagagcagaaacatcatcgaacagcttttctcgcacctcccttcccagcaagcaccggctagctgtcagtatgatgaggtgctccaactcgtacttcaaatcaacagtgccactttctccccactttgagaagtactcctcagcctcagcaaccatctggtcgacatagctgcgaagcttattagcccggagcgcctcggtaaagaacctgaactgctcctgcctgacggagtagtcgacgtcgaagacgacgccagggccgaaggtgggcacgttgaacttgtacacctcctgctggctcatctcggcctcgttgcccttgaagaagtgcgccgacacctcgggcccgatgaggaacgtgatcttgcgggtgatgatgggcaccgtgaagacgctccccaggcgcgcgtactgctcccggatcatcgggatgggcccgcgcatgaacttcaccagcccgcccaccaccggcgcccccgggatcgtcggcggcaggcgcttcttgccgccgcccccggagcggaagctcaggaggagcttgaggaaggcgatggtggctaccagcagcgccgcgcccgcgatgagccgctgctgctgcgggatgtcggcgagatccatcgcgttttgctttccgtattccaattcggcgggacgggggcggcgatgcggggggagtgtggagtccgggtgcttatataggtgtgccactgccaaatggagggagtggagtggcacagcgggagatcccgtggttgggggaggagtggatggattagcaatggcggatgggaggtttacggggggcggaaacaggggcggggaagagagagagatggcgg

SEQ ID NO: 271 - DNA, 1274 bp, Saccharum
tcgacccacgcgtgcgccgcagttcccccgaccacaccgttccgccgcgcacagaagccagccccgcgccaggagtaagtttgttctttttaacaatatgtcgagggaggagaatgtttacatggccaagctggctgagcaggccgaaaggtatgaggagatggttgagtatatggagaaggtggctaagactgtagatgttgaagagctcactgtggaggagcgtaacctcctgtctgtcgcatacaagaatgtgattggggctcgccgtgcttcatggcgcattgtctcttccattgaacagaaggaggagtcccgtaagaacgaagagcatgtgaaccttatcaaggaataccgcgggaagattgaggctgaactgagcaacatctgtgatggcatcctgaaactgcttgactcccacctagtgccttcctctactgctgccgaatcaaaggtcttctacctcaagatgaagggtgactatcacaggtatcttgcggaatttaagactggtgctgagaggaaggaatctgctgagagcacaatggtagcctacaaggctgctcaggacattgctctggctgagctggcacctacacatccgataaggcttgggcttgctcttaacttctcagtgttctattatgagattctgaactccccagacaaagcttgcaaccttgcaaagcaggcgtttgatgaagctatctctgagttagacacccttggggaggagtcatacaaagatagcactctgatcatgcagctcctgagggacaacttgaccctttggacctctgacctcacggaggatggtgctgatgagggcaaagaagcctcaaaaggcgatgctggcgagggacagtaatcttcggagagggcatgttgttccagcctggttttagatgctctatgctgtcgaagctgtgccgtgccattattgtagcagatttcctctccccctcacttcttttgcctcatattagtaggctggtagtggtcgaattagttcccattgctttgtgttgcagctagttggcactaggtccgtgtggactggtattgttcccctggatttgacaagcatgtctggtcgctctagcgttttattgagctttgaagttatcacatttatttctgtcgcaatcagttattgtctggatatgcggacggctgtttgaatctgcggtttaacgagctgagcctcttggcagccagagttcctcaccggagctgtgtaccaatgtggaaaataaaatggtaatgctttgttt

SEQ ID NO: 272 - DNA, 1174 bp, Saccharum
tcatacaatacagcttttttttaacaacttgcaacaattatttgttccactgacacaccgtggtaattataagtaaacaacttttgatggacaagatgcaaaagggccccttgattaggagcagggtgcctttgcattttgtgccaccaaaaaaaaaagaaaaaagaagaagaggagagaacaggtagtgcaaaaagacattgttataggacaggtacacatgttcatgtcttctctcttctgtataggacaagatgagacttgaacactgactgactcgtttactgacaaactagcacagatagaacagttgacacaccaaaatgacttcattgatcaggagatatagaggcttggaggacagagacgagtatgatacagagacgagcagagctgcaaaagctgtggagatcggatcttcttgcatccatccttggtgttcagatgcaagcttccatcttctcctcagctcctgttcttgcatttctccatggccctcggcgcgaggccaatggcttctgatcctttcatgatccgaaggcgcttgcatgattcgacgaacatctcccacggcacgtcgccgacgagcatccagtcgccgtccttgtcctcgtaggtcggcacgtactcggagccgttgagcagatccaccagcttgctctcgttcatgccgttcatcccttgagacccacagcttccaatggtgaaggagctgaacatcttctcgagcgccttggacagctcctggtagctcttgtacatcttgaggtccaccttgcgcaggtatggcgcgccgtccaagctcaccttcacgaacgcggcaccgccaactgctgctgctgccgccgccgccggcgaggacttgtcggcgtctttgctgccgccggcgcccttgtcggactgcaccgacatgatgttcttccggaacgaccggaccggtggccatcccaccacctgagctttgggggcgcgcggcttctcggcggggtcagcctgaacggcggcggcggtgacgacgctgctctggctcggggaccgcttcatcttcccgccggcctcctccgcggcggcggcaagggcaacaccaccgtcgtcctgctcgtcgtcctcctccgccttcacgacggccgcgggggtcgccggctctagcttcagcttgaggtcgatggtctcg

SEQ ID NO: 273 - DNA, 1842 bp, Saccharum
acggtccggaatcccgggtcgagccacgcgtccggctgccccgttcgaatctcgcatcgccttcgccgccgccgccgccgctagatatagacctgagattcttcccgagtccgttcggcgatggtaacgatccagtccgtgaaggcgcgccagatcttcgacagccgcggcaaccccaccgttgaggtcgatgtgtgctgctcagatggaacctttgcacgggctgctgttcccagcggtgcatcaactggtgtttatgaagctcttgagttgagggatggtggatctgactacctgggcaagggagtttctaaggctgttaacaatgtgaactctatcattggacctgctcttattggcaaggaccctacggctcagaccgagattgacaattttatggttcagcagcttgatggcactaagaatgagtggggatggtgcaagcaaaagcttggtgccaatgccatcttggctgtgtcgttagctgtttgcaaagccggtgctagcatcaagaaaattcctctataccagcacatcgcaaatcttgctggcaacaagcaattagttttgcctgtccctgcatttaatgtcatcaatggtggttcccatgctggaaacaagcttgctatgcaggagttcatgatcctgcctactggagctgcctcattcaaggaggctatgaagatgggtgttgaagtttaccaccacctcaagtctgttatcaagaagaagtatgggcaggatgccaccaatgttggtgacgagggtggttttgctccaaacattcaggaaaacaaggaaggacttgagctcctaaagactgcaattgagaaggctggatacactggaaaggttgtcattggaatggatgttgctgcttctgagttctacaacgacaaggacaagacatatgacctcaacttcaaggaggagaacaatgatggttctcagaagatatctggagacagcttgaagaatgtatacaagtcgtttgtgagtgaataccccattgtctcgattgaagatccatttgatcaggatgattgggttcactatgctaagatgactgaagaaattggggatcaagtgcagattgttggtgatgatctccttgtcaccaaccccactagggttgcaaaggccatctcggagaagtcatgcaatgctcttttgctcaaggttaaccaaattggatctgtcactgagagtatcgaggcagtgaagatgtcaaagcatgctggctggggtgtgatgaccagtcacaggagcggtgagactgaggatacattcattgctgatttggcagttggcttggctacgggccagatcaagacaggggctccctgtcgatcagaacgtcttgctaagtacaaccagcttctaaggattgaggaggagcttggtgctgctgctgtctacgctggtgccaaattccgtgcacctgtggagccctactaagctttagtgatgcttggactcggaacactgcttcagtttgcacgagttttctgataacagattatggcgccctccacatacttgtggattgaactctactaaagctgtgatcgagcaataatttcccacatgttagttgggagccggacttgttgacaaactctactttggtcttcttttgttgagcatgaacatgttagacagtagaaacagatgttttgtcggctgtttattttggattattctggagtctagttagtctggtatcgtttcctgctgattgcgagtttttttctcgagcgaattgtgagtttttttttctcgtggatgttaaatagagaatgattttcatcaaaaaaaaaaaaaaaaaactcgagggggggc

SEQ ID NO: 274 - DNA, 2407 bp, Saccharum
agagacaaatatactttcatgcattagcagaactcgccaatggttttcgctgtgcgcgtgcatcgaggccagaagaaggcgtcatatgcaacaaaagccatgacaacgtcgtgtgacctccatcactgcaggagaaaacaagagggggcaaatccaaagattattacaacacaggctacatctcatctgactatctgtgttccccaaaaaaaagagtagctacttctaaacatgccgctacaattcacttcaccttccgcagcctcacttcttaacctcctcatactctgcctccggcgcctggtcgctgccaccctgaggtccagatcctgactgcgagccaccagagccaccaccagacatgtgctgtccaatcttcgagacagccttgttggcagcctcaagcttggccttgatcttctcgatgtcatccgaggccatctcctggcggaggtcagcgatggccgcctcgatctcagatgcaacctctgccgggatcttgtccctgtactctcccagactcttctcgatgctgtagatagtggtgtcggcattgttcctgatgtcaatgagggctttccgttcctgatccttctgggcatgcagctcagcttcttgcaccatcttctggatgtcagcctcagacagcccacccgaggatcggatggtgatgttctgctccttcccagtagccttatctttggctgagacagtcacgattccattggcatcgatgtcgaacgtaacctcaatctgaggcaagcctcttggggcaggcggaatgcccacaagatcaaattcaccaagaagtttgttgtctgcagccatttcacgctcaccttgcaagacacggatacccacttgggtctgattgtcagcagcagttgagaacacctgacttttctttgtagggattgtagtgtttctgttgatcaatctggtgaagataccaccgagggtctcaatacccagtgacaggggagtaacatcaagaagaagaagctccttaacatctccacggagaatgccaccctgaatggcagcacccatggccacagcttcatctgggttgactcctttgcttgggctctttccaaagatttcagagactacctcctgcacctttggaaccctagtcattccaccaacaagaagtacttcatccacctctttagtagatattccggcatccttcaggcagttcttgcatggctctctagtcctctcaatcagattgtgtacaagagattcaaatttcgaccttgtcagtgtgatgttcaaatgttttgcccctgaagcatcagctgttatgaatggcagattgatttctgtctgagaagtcgatgaaagttcaaccttagccttctcagcagcttcacgaagcctttgcagggccaatctatcctttgacagatcaatgccctcagctttcttgaaatcactcaccaagaactccagtagtgtgttgtcaaaatcttcaccgcccaagaaagtatcaccatttgttgcttttacctcaaaaactccgtttgagatctccagaatggagatatcaaaagttcctcctccaagatcaaataccgctatcaagccttccttgttgttcattccataggacagagcggctgctgtaggttcattgatgatcctttcaacatcaaggccagcaattcggccagcatcctttgtggcctgacgctgagcatcattaaaataagctggaacagtaatcactgcctttgagacagacttgccaaggtaagattcagctgtctccctcatcttggtcagcacaaatgcaccgatctgacttggtgagtactgtttcccatctgttgtttcaacccaagcatcaccatttggagccttcacgattttgaatggcaccatcttcatctctttttgtgtctgtggatcatcaaagcgtcgcccgatcaacctctttgttccaaagaaagtattttgggggttggttactgcctggcgcttggctggagttccaacaagtctttcgcccttctgagtaaatgcgacaacagatggtgttgttctcgcaccttcagcattctcaataacttttgggttctttccctccataacagcaacacatgagttagttgtccccaaatcaatcccaataacctcatttccagcagctttggcactaaaaggtcttgcaaaatttccccattttgagcatacgttggccgcacatgttgactgtaagctggcgcccagggatccgagaggggacgcgagctcccttcggcgcacggcgcggaggagcagcgacgccgccatagatggctggtcccgggctctagcgtgcggaagcaagggtggctgcggctgcggctgcggctgcggcgagggttttggaaggggatgcttcgggagacggctgggg

SEQ ID NO: 275 - DNA, 1633 bp, Saccharum
cccaaaatgatttgcattattattctctcttagaagagcttctcatcatcagtcttagctcctataaagtttaatcctcatgaactagactgaaattatttcagaacatcggcacgacagaatgatttctcatcagagattattagaaaggactagcttgtgcatcctggttcatcttcttgggtgcagcagcttcaatggcagtgcccagaggccatgcggcctcaacgtagaactccccatacttcactctagacaccaaagtaatctccctcgttggagccaaaccaaagccatctacaagcaatgtgtactggtagatgagatccatgcatatgtatggcacatcatagagatcagggtaccctgctttggcttcatcagcgctcagcaaacaaactttctctgcagcagctttgaatgccgatggggtggacttcacgctgggtgcctcactatcaatgaagccaacctgtgaagccttgtcaaagaagaaagatgcaacatagagatcgtcctggccagctccaccgcctccgttccagacgccattaaaggtgcagttctttgctttacatggtgcactcaagtttagtgcctttattatctcttctctgcacttgtcatacactgcgccttcaggtgacgctgttgcatcatagtccttcccattgtagctgtatgtaccactgaacccacgcaatacgcagtggctaaatgttccattctttgccttcaggatctctactcgaacagcagacatgccatagtacaagtagctgtgaacatagaggttataatctttccccttgaggtactcctttgttatatatggatccttcccatcaggcacagctggggcatttgcagcagcactcgtggaaatggcatatgccatttgcactgagccaccgcccaaatcgatcacaccaaccgtcttcgagtagtcccctcccagcttacctaacagataattcagagcaacccataggtaagatccttcttgagttccctctagaacagtgatccatttgggattgtactgaaatttgctcttggtgtggacaagatctctaaccgcttcaagaatctcctctgccttctcgtctccgattaatcttagaccagctgttgccccaagtttgagcggagtatttttctgaagccagagagggacaatcttcttagcctgctcaagaagggggagtatagagtctgcagcctcctgaggtttccctgcaaatgagctcagcccaggctttatcttggagaagaactcgatgtcgtcgccgatggggacgaggtcgagctccttgtcgaacttgaagacgtgcacacggctgcccgtgctcccggcgtcgaagatgacggcgtacctccccgttggtcctcgtaccctcgagaccgcctcctccaccgccggcgactgctgggcggcggcgatgctgctgccctttcgcccaagaacgacgccgctactgcttccagaggtagcggagacgaggtggaagacgacgagaagcaaggcagcaatgctgccggcgaggcgagccattgccactgccactgcaatggccagttgtagcaacagcagggaggagccgccggccactcacttgtcagttgtcacttc

SEQ ID NO: 276 - DNA, 982 bp, Saccharum
atccataatttgtgtggtgaaatgttacctgcggctgtacaagagggagatggtaagagataacatatgctttgcttgttttaagcgaactcgtgccagacagcacaccacacaagtgtgaacaaagtacctggtagatgtccctcaacttttactggcgagttcacattaacacaataaaaactgcagctatttgttgcttactgctagtctgatcatcaagatggaattatggacacaaaaagtcaactccaacagaggcaaaactggcagtgcatttggtatccaacaaacatacaattcatggtacacagattaaacttaaactggagtactaaagggcaactcatttgatgactatcgatgattacgaggtgtttgcttgggccttgttgaggatgacaccctcgtacttcacctggaaccacttcatggcgtcttctttggtcaccctgtgctggatgccaacgcgagacttgcacctgcgccggcgagcaacacggtaaccagcccgctccagaacgacgtaaaagtccataccataaataccagtagatgggtcatacttgatgccaagatcaatgtgctcctgaataccaaaaccaaagcagccagtctcactgaagttcctcctcagaagctcatactccttcaccttgaggccactctcgagaagctgcatcgccttctcacccctgactgtgacgtagcacgcgatcttctcattacgacgaataccgaaagacctcacggtataccttgccttggagaaaacaggggactgcccactcaactgctccaacaccttggcggcgcgggtaagtcgatctccactctctccaacggagatgttgagcacgagcttctgcaccttgatctcccgcatcgggttcgactgcttcttttctgacgccatggtgatcgtggagaacagagacggcggcggaggggggaagagacggagggttttggtgttggggat

SEQ ID NO: 277 - DNA, 1718 bp, Saccharum
atcacagtaaaaaagtgaggtaccacaagctaacatttttagaccataacaacgttcataataacccagtaacaaagcagggaatttaacattcaagtcttacaacatcaggtgttgtagatcacacacaatcgacagatagttcaaaccaacacataacatgatagatcacacagctctcaggataatagcatcacatggaccaaaagcagcagcaccaatagtctagtactcatcaccctcgtccccttcctcaccctcgtcaaactcagcaccaacttcctcatagtccttctcaagtgctgccaggtcctcacgggcctcagagaactcaccctcctccatgccctcacccacgtaccagtgcacaaaggcacgcttggcgtacatgagatcgaacttgtggtcaatgcgtgagaacacctccaccacgctggtggagttggagatcatgcacacagcgcgctgcaccttggccaggtcaccaccaggcaccacgctggggggctggtagttgatgccacacttgaacccagtcgggcaccagtccacaaactggatggtgcgctttgtcttgatggtggccacagcagcattcacatccttgggcaccacatctccacggtacatgaggcagcaagccatgtacttgccatgggggggtcgcacttggccatcatggaagatggctcaaaggcgctgttggtgatttcagccacggacagctgctcgtggtaggccttctcggcagagatcactggggcgtatgatgaaagcatgaagtggatccttgggtaaggcaccaggttggtctggaactcattcacatcaacattcagagcgccatcaaacctcagggatgcagtcaaagatgagatgacctgagacacaagcctgttgaggttggtgtaggttggccgttcaatgtcaagggagcggcggcagatgtcatagatggcttcattgtcaagcaggacagccacatcagtgtgctcaaggagcgagtgggtggacaggacactgttgtatggctcaaccaccgaggtggacacctgaggagacgggtacacagtgaacccaagcttggacttcttgccatagtcaacagacagacgctcaaggaggagagaaccaaggccagagccagttcctccaccaactgcattgaagacaaggaagccctggagaccagtgcagttgtcagcaagcttcctgatgcggtcaaggcacaggtcaacaatctccttgccaatggtgtagtgaccacgggcaaagttgttggcagcatcctccttgccactgatgagctgctcagggtggaagagctggcggtaagtgccagtcctcacctcatcaatcacagtgggctcaagatcaacaaacacagcacgggggacatgcttcccagcaccagtctcactgaaaaaggtgttgaaagcatcatcacctcctccaacagtcttatcactgggcatctgaccatcagcctgaatgccatgctcgaggcagtaaagctcccagcaagcgtttccaacctggataccggcctggccgatgtggatcgagatgcactccctcatggtgccgtcgggagggtggagcggcggcgggaaatgggaggagggtttaaaagctttgggtcgcagagagaggcgagtacgaagacgccttcctctgcggtgctcagcttagggtttcagactcttcccactcggcac

SEQ ID NO: 278 - DNA, 878 bp, Saccharum
ccctattacgaaggagatgacaatcagaatgttgtagttctacgtgatattctgttaacatattccttctacaattttgatcttggttattgccaaggaatgagcgactttctggctcccatactttatgtcatggaggatgagtccgaatcattttggtgctttgcttccctgatggaacgtctgggcgccaattttaatcgtgaccagaatggcatgcatgctcaactacttgcattatccaagcttgtggagcttcttgatcctccattgcataactattttaggcagaatgactgcttgaactacttcttctgtttccgctgggttcttatacagttcaaaagggagttcagtttcgaccagatcatgcttttgtgggaagttctgtggacccattatttgtcagaacatttccacttgtacttgtgtgtagcaatcttgaaaaaatatcgtcagcggataattggggagcagatggactttgataccctccttaagttcatcaatgagctcagtggtcagctcaatcttgaccgggctatccaggacgcggaggcattgtgtactattgcaggagaaaacggggcctcctgcattccacctggaaccccaccttcaatgcccattgagaccgatggtggcctgtatgtgcaagaagacgaggtcttgtgagatgtcagcagtgaccctagaaaataattgcacagaagcatcacaagtttttatcctgtagtgctttcgtcgacgtcataaatgtgatccgttgtaaggttatatcaatggaagaatcatgaaatctagagttgtgtgtgtatatgctccctcgataaacctgtaattgatactttcacttaatagatatggattctgtatgg

SEQ ID NO: 279 - DNA, 2213 bp, Saccharum
  misc_feature 623: n = A,T,C or G
caccaacccggccccggtgcctaatccacagcgaaagccacgatgctgaggctgagcgcgctgctgctgctgttcttcctctgcctgtgcgcgttccccgccccgacgcggtcgcagaacacgaccacggccacggcggcgccggcgtccgtcgaggggttcaactgctccgccaaccgcacgtacccgtgccaggcgtacgcgctctaccgcgccggtttcgcgggcgtgccgctcgacctcgcggccatcggcgacctcttcgccgtcagccgcttcatggtcgcgcacgccaacaacctctccaccgccgccgcgccggccaacggccagccgctgctcgtgccgctccagtgcggctgcccctcggggtcccccaactcctacgcgccgatgcagtaccagatcgcctcgggggacacctactggatcatctccaccaccaagctgcagaacctcacgcagtaccaggccgtggagcgcgtgaaccccacgctggtgcccaccaacctcgacgtcggcaccatggtcacgttccccatcttctgccagtgcccggccaaagccgacaacgccaccgcgctcgtcacctacgtcatgcagcccggggacacctacgcgtncattgcggcggcttctccgtcgacgcccagtcgctcgtctccctcaacgggcccgagccgaggacgcagcagttcgccgagatactggtgccgctccgccgccaggtgccgaattggctgcccccaatcgtgctccggaacaacgcctccgcgacgccagcgtccccgccgccctcggcttctcccaacgcgaccgtggtgagcaacgaccggaacggggtggtcaccggccttgctgtcgggctgggcgtcgtaggcgcgctctggctgctgcagatgctgctgctggcctgcttgtgcagacggctcaaggcgaggggacgacgaggtgaggcggtggcgagcggcgacggcggcatgtccgctaagagctcgtccgccgccgccgccggcggcgcaggggagaggttcctggtcagcgacatatctgagtggctggacaagtacagggtgttcaaggtggaggagctagagcgcggcaccgggggattcgacgatgcgcacctcatcaacggcagcgtgtacaaggccaacatcgacggcgtggtgttcgccgtgaagaagatgaagtgggacgcctgcgaggagctcaagatcctgcaaaaggtgaaccacagcaacctggtgaagctggaggggttctgcatcaactcggcgacgggcgactgctacctggtgtacgaatacgtggagaacggctcgctcgacctgtggctcctggaccgcgaccgcgcgcgccggctgaactggcgcgcgcgcctccacatcgcgctcgacctcgcccacggcctgcagtacatccacgagcacacctggccgcgcgtggtgcacaaggacatcaagagcagcaacgtcctcctggacggccgcatgcgcgccaagatcgccaacttcggcctcgccaagacgggccacaacgccgtcaccacgcacatcgtcggcacccaggggtacatcgcgcccgagtacctcgccgacggcctcgtcaccaccaagatggacgtgttcgcctacggggtcgtcctgctggagctggtgtccgggcgcgaggctgcggacgagagcggcgagccgctgtgggcggacgccgaggacaggctgttccggggccgcgacgagaggctggaggcccgcgtcgcggcgtggatggacccggcgctcgcggagcagacgtgcccgccggggagcgtggcgagcgtggtgagcgtggcgagggcgtgcctgcacaaggacccgtccaagcgccccagcatggtggacgtagcctacacgctgtccaaggcggacgagcacttcgccgactactccggtgagagcgtgtcggttgacggcagcggcgaaatcgctgctcggtgaaacatccttcctttgctagtactcctcctactcagtagtaataggcttgagccatcaggtcgcgttgtaaatgttaaaggtctagcgtctagcgagcggaggatgagtcagcagtagtatccaggaccttaaaactcaccgtgcattgttgcacttttcttttgggcgtgctctgagtcgtgacgtgccgatgcgtggcacatacagtttgtagaaaaaccgtcaaccgtttag

SEQ ID NO: 280 - DNA, 727 bp, Saccharum
cacgcaaagcaggaagctttttattttctcatagctattcacaggttccccttattacaagatttctggaaaacaagttcatggctacaaaagtttcagatctccctcttgaacccacacccatgacccatgccatgcatgaactgcccaagatctcagcctctccaacaccagacatggactacgtaccttgtttttttcacaccatcatacccatatatccatatgtacctagtatgtcatgttcatgttcatgttcatgtccatggtgcaagcagcaagctccataatttacaagacaagctccggttcttttatggttcagttctttgcagatctgaccaagacatggccacacaagcggccatgctcttgcaaacccagatctcggtttgtgttttatgtgtggccccagggagccaagaacatgactctccttatggggtcctcggcggccgagccgcggcagtcggtgccacggctcggttcgcccgccggcctggccgccggtgtggcggcagcgccgtaggagcgccggagtttctcacggagggcctgcttgacctcgtgagcccaggagccctccccggccggcagctgagggggtttcatggctggctggctgccttgccaaaagaccaaaaattcctacaggctacagcagtggatgcacgaggctaagcaaccagagagtgtgtgcgcacccacgcgtccgcccacgcgtccg

SEQ ID NO: 281 - DNA, 2477 bp, Saccharum
ctcttcccttctctctccccacccaccgccgcgccgggccaccacccactctaccctctctctctctccccacctccaccaccaccaccaccagcacccaccaccatcccggcgcggagaccgcttccctccctccacccccgcaaccctctcccgcctcgcccgcgcctccctccatttgtccgcgcccccactccctcccgatcttaaccacccgccgcgcccctcccgccacccggcttcctctcccagtctcccccttcttcctccctcaaaccagacgctcgccccccctttccaccacctctcttcttcttcttctccatccagactaccaggaggaggaggtaggaggaacgacacctagcacgaggcctctccctccccccttgaagcaccccgtagcgagagggagggcggaagaggatgagcgcgtccaggttcataaagtgcgtcacggtcggggacggcgccgtcggcaagacctgcatgctcatctcctacacctccaacaccttccccaccgactatgttccgacggtgtttgacaacttcagtgctaacgttgtggttgatggtaacactgtcaacctcggtctctgggacactgcaggtcaagaggattacaacagactgagaccactgagctatcgtggagctgatgtttttcttctggctttctcactgatcagtaaggccagctatgagaatgtttcgaagaagtggatacctgaactgaagcattatgcacctggtgtgccaataatcctcgtagggacaaagcttgatctgcgagatgacaagcagttctttgtggaccatcctggtgctgtccctatcactactgctcagggagaggagctaagaaagcaaataggcgcaccatactacatcgaatgcagctcaaagacccaactaaacgtaaagggtgtgtttgatgcggcgataaaggttgtgctgcagccacctaaggcaaagaagaagaaaaaggcgcagaggggggcatgctccattttgtgatttaatcatcagtagacaaagaaacaagggcgaaggtgccatggttttattatcgtcgcgtcttgcttcagcgaaacagcatggatggtcccaccccctaggtttactggcggctgcagcgagttctcatctctttgtcgaggcattgagcgatatgtttgtttcatttcctacttcctgccttgtgattatctggtgtgtgactgacgaagtcgtggcaattaggtaacttgcttagaaggtatttcccgtgtttgagcaaaaaaaaagtatcctgttatctctgttccataagtagacatgatgtaatcgtactaagtttatttttacttatttcacttcaatggaaaattatgcttcccattaaaaaaaaaaaaaaaaaagggcggccgccctttttttttttttttacattgctgaaacgaaacgatcgacaactgaacaagatcgatctagcattaaactaattaagcttacatcagtaactatcactgtgaatgaatctactccagcaattagtgatcagaagaaatgttttcgctttcttgtctcggaactgatgaccaaccaaatcgagcagctagctacagatgcaaaagaactggcagaagaacagaacctctcaagaaggagtaagaagatctaccactgggtaacttaactaacaatgacttaagctctgtagtagtagtagtaaacaactctcatcaacggcacggcggcatctggatggggcgccatgccgacgcggtgagcaggcagaggtccttccacccgagcttgagcgcgccgttctcctccaccagcgtgtacccgtccgaggggaacattcccagcagcagcgacgcctgcgccgcggcgctgccggcgagcgaggcggcgcggaacccggactgcgcgagcttctcgcgccagctgccgaacttgacgtcgccggtgcgcgcgggcccgccgacggccagcacgttgcggatctcccgcgacagcagctgctgctccacgacgtgccgctcggggctgtcctcgccgtagctcgcgtccagcgagtcgaacagcgccgagtagtagtggatggcctccacgaaccgcgccaggaacgagcccgactggatcaggtcctgctccaccattgtcaccaccttcggggccagtctttggataagccagagcgtgttggaatcggagccggtgacgtcgtagagcgagtggtggagccagtggacggcgacggcctcgcggtgcgtgacgccgagcttgtccgggtcaacattgccggccttctcggggacggcgcagaactcgaagggcaggccgagcgtgtcggcgaagtcggagaggcgtttccccgtggcctggagagcgtccatggacgcgcccaggccggcgagccggaccctgggcgggccgccggggcgggaggcgaggatgtggaagagccccggccactggagcccctg

SEQ ID NO: 282 - DNA, 1785 bp, Saccharum
ggtttggaacaggataaaacgatgttcggctttatttattttgtgttgtttgcggcagtaaaacacataataagaaatatttctcatcagatatataaaaaaaacaggacggataaaatgtaactctgacagctggctggtacggtagcagtactaaacttcggcacgcgcgcgcttgtcgtgtcaccgatcgaccactacgccgccgctgcgcggtgctggtatctggtgggccgcacgaccagcggcgccttgcggtggaacgtgagcctgccggtctcctccatgctcatgtcctccggcgtcatccccgccggcagcgcccagtcgaagcagtagagcaggttggcgagagtgaaggtgacgttggtctcgcccatggcgaggcccgggcagatccggcggccggccccgaacggtatgagctcgaagtgcgagccgtagtagtcgacgtcgctcccctggaagcggtccggattgaactcatcgggtgccggccagctcgccgggtccctgccgatggcccacgcgttgaggaacacgcgcgtcttggccggcacgtggtagccgcagatggtggtgtctcgcatcgtctcccggggcaccagcagcgtcgccggcgggtgaagccgcagcgtctccttgaccaccattttcaggtacgggatcttggcggcggcgtcggagtccacgcgcggcatgttgccgcccaccgcggccctcacctcggcctgcgccttcatcagcacccgcggcttgcggatcagctccgacatcgcccacaggatggtcacggagttcgtgtcgatggcgccgatgaaggtgtccatgacgatggccttgacgtggtccctggtgaagcggagcgggccgtcgttctccttccaaaggttgatgaggacgtcgacgaggtcgccgccgccattgtcgggctcgggcacggggcgcgccgccgggtccatgtgttggtcgatgatcttctcgaagaaggcgtcgagctcgctgaagatgcgctcacggcgcgctaggaagcccgtgaggcggtcgacgaggcggccggcggcgttggggaagaagtcctctgcggagaagctggccaacatgtccatggcgtcgtccagcacgtgctggaagtgctccctgtgcgcaaactgctcggaggcgtagatgttgccgagggcgacggtgccgatgatgccgtcggtgagcgtgaagatgtggtcgttgagcgcaattggcgccgaggctgcggctgcgcggtcgaggacagcgacgagcttatccatctgctgctcgcgcgcgtagcaagcagccctgacgcggcgcccgctgaggagctcgagggcgaagagcttgcgcatctcgcgccagtactcgccgtagggcgcgaaggcgacgtccttgtggtcgtaggagaggcgcttgggccccggcgacgcggggcggctgcagcagtcgacgtcgtgcaccttgagcacctcccgcgccgcctcagcgctggacaccaccacggtcggcaccgtgcccagtcgcagctgtaccgccgcgccagctggtggaggttccggtgcggaagcgggcccagcaggtgcaggttgcccaggaccggcacctgcatggggcccggaggcagctgcggcgccccgccgtccttggcgctcctgttggtgaggaggaggtaggacgacagcagcaggacagggaggagggccaggaggcccatctgccactgctgcggcacgccgctgctaaggagctgggaggggagtagtgaggtggcgatgg

SEQ ID NO: 283 - DNA, 745 bp, Saccharum
attgggcccgacgtcgcatgctcccggccgccatggcggccgcgggaattcgatttcactcgaggtgatcaatactcatgttcatcctcctccagtgacccagcctgtgatgtcttctcgtggtcattctcaagctggctgaagttccccttctccttgatcagctggatgtggtggtgcttgcagtacagcttcccctcgtgcgcaatgtagttagaagggctgatggtgcaccctccatggcagcacttgaagcagctcttgtggtacatagtgttgttaacagtgaccctctcagttggatagactgtcttgctgcatccaacacatttctctctggtgccagcaaaggcgcttgagactttagtagcattctcattcccaacgtttctttctggcttgacaaccttcggagttccttcgaagctcttgtccaagctccctgtcctcttgaacagctggtcgaagtgaggcctgcagtagagcactccctcgaaggagttgtagttggcgagcttgagggtgcccttgcagtggtggcagcggaagcaggccttgtggtagatgcggttgtcggcggtgagcttgtccacaaggtacaccgtcttgtcgcaggcggtgcgcttggtggtcgtcccctggaaggaggtcgccatgtcgacgagctcaatcactagtgaattcgcggccgcctgcaggtcgaccatatgggagagctcccaacgcgttggatgcatagcttgag

SEQ ID NO: 284 - DNA, 1502 bp, Saccharum
gtcgaccacgcgtccgcgaccgagcccgaggagaccacagtaccacaccacaccgcctcctccgcccagccacctgcgcccgccgattcgtcgagctcgcctcgcgccctcgcccgctcgcctagctccccctgcctcttcttcccttcctccccacctcctcccccgcgaccgtgctcctgcatgccagcgcgctgaccggccgacgacggggtcggggtgggcatcatggacaagtacgaggctgttcgggacatcgggtcgggcaacttcggggtggcgcggttgatgcgcaaccgcgagacccgagggctcgtcgccgtcaagctcatcgagcgcggccaccggatcgacgagaatgtgtatcgcgagatcgtcaaccaccggtcgctgcggcacccgaacatcattcagttcatagaggtgatcctaacaccaaggcatcttgcaatcgtgatggagtatgcagctggtggtgaattatttgatcgaatcgtcgatcgtgggcgatttagtgaggatgaggccaggtatttcttccagcagttgatctgtggagtgagctattgccatcacatgcaaatatgccatagagatttgaagctggagaatgttctcttggatggcagcccagctccacggcttaagatatgtgattttggctactccaagtcatcagtactacattcaaggcccaaatcagcagtgggaaccccagcatatattgcacctgaggtgctatcccgtcgtgagtatgatggaaagcttgcagacgtatggtcctgtggggtgactctttacgtcatgcttgtgggagcatacccatttgaagaccccgatgaccccaagaatatacgcaagaccattcagcaaataatgcaagtgcaatacaagataccagattatgtccacatatctacggaatgccagcaacttcttgcccgtatctttgttgccaatccaatgaggagaatcacaatgaaggaaataaagagccatccatggtttttgaagaacctaccacgggaactcacggagactgcacaaggcatgtactataggagggataacagggtgccttcttattcagaccaaacgtcagaagaaatcatgaagatagttcaagatgcaaggaccatgctgaaatcatccagatcaggctatgggtggagcagtgagtattcggatgatgaagaagagaaggaagaggaacacaggccagaggagcatgaggaagaggaagatgaatacgataggagggtgaaggaggtccatgcaagcggagaactccgtttggacgctcttcacatatgaaagctagtggaaggaagttacgtgtagataactgggttgcggatctgaaggatccagtgggatgtatgcaattttggcttcagaattgcttctgtttggtcaattttcatgtaacataatttaatacactgagacagactaccatgttcttatattggtaaatatgaagcatgtacctgtatgtctgc

SEQ ID NO: 285 - DNA, 2371 bp, Saccharum
aggataattcaggactacataagtagacctgggttgtccaaaaaaaaaccttgtatttcttgcttacagaaagctactctacttgataagttacacccaaatcagtacggggactgtaaagaaatcttctaagatacaagcttttgaatagagtacacgaccaacgaagaattccaaaaattgttaccaacattatgtggtgcagcaatcaccagccaagcacggtatcctggctgcttcagtgccacccctacaagggttgaccatttttcttgccacaggatgactccttagctaattcttgttcgtcgggtaaggttgggttgcagaattcctcatgttagaacctcagaaacgtgcttgcttcaagctacagccgtctgattcccaccaacccagtactgcttcacggcatataagatcttctcgcgcacgagggggctgtcctcgtgatcaaccatcttcgtgttccacctcatacccagagcgaggctgttcaccttggtcaggacatcaacatcgtcccgtattatgacagcaccttcaggcctcaagatgcggtccatctccaggagaatgtcttccatgctgcacttgtttttatacaaggtgaaaagaccgctagcatggataagatcatatgtccttggataagtagagaaagcctcacaccagtcatgatatatgccgatcaatcctcgctcatacacagcccccagggtgggcatctttgcgatggtcggcacaacattcatcacccaagattttggggactctattgctgctgcgaatcccccgagtcctgcattcatgtccataatattcctgtatctaccagtaagcagatacttgttcacactgctgtaagccttcacatgcttcttccacattttattgtctttctgaaaggcctcagatgaaacccctgggatcaaaccattagcaagtcttggaggaactgcattgagcctggctgggaagggtttgattgctcctccagctacttcgctttcatcttttacatctggaaggggtgtcacacaggccttcatcttcttgtaccagacatcatctgggtttgttgattcacacatctgcacagttgattcttcttgcctagaagggcaagactcagtattcacccttttcctccatattgccatctcacccttctctgagattttttcccaacatagaaggtcagcaatttcctctattctgttctgctctgcctcaagatccttctttgtgcgttgccaacccttgtagttaaccttccaattaattggaggaccggacagcacccagtagccaccaggccttagaaccctatcaacttccatcatgtacattccatcgtttgctccccatggaatcaagcacctggaacaatgggccatgtcaaaggccctcgatggatagggaagttttattgtaccaaggacaccaataacagctgggacacctctctccaaagcaaactgtacttgtgcctcatgcgaatctctaggtgcaaatgacatggccaagacattcctcttcagcaaataagctccccagctagccaccccgcaaccagtgtcaagtgcagtcctgacagttccattggcgatcggaatgactgatgcaagctgatcaatatacttatctgctccttgtgggaattgtgtccctccaccagggaatctgaacacattaccctcatactgaacccagttctggatggctttctcgaccgtcaagctcttatacgggcaattcacaaaagggacatagtcccgactcttgggccacgggaacggagccacatagcctttcgggggtgggatcagacagtgcagcttctccttctgtgcggggcagtgccgctctctgtaattcatgttctcccgaggaaacttcatcgccctgttctgatcttggcagggggtgtaatccgtgtagtgatcagcacacggcttgaacttcttcgccggcgagacaagatcgctagagctgctgccactagctttaggattgtgggtgtcgaagctaaggttaggcaagacggtgcagtcggtgcgcttcgtgacctccagcgcgatgctgtcccccttgccgaacccgctcttctgccacgctccgaggatgtagaagaagcagcacatgccaatgactatgcataggaataccgtgctcctggtccggttgtcgccggagctcgccttcaaagccatggcttacttaccctggtggtggctgccgccggcgaagggcccgaagaagacctgggcacctggcacagggcggcagcgacggccgcccagtcgccgccgacagaaagagagggagggtagggggagaagcgcgcgcgctgggtaaaggaaggggt

SEQ ID NO: 286 - DNA, 1202 bp, Saccharum
cacaccaaagcgacacgttattccatgcattgatcgataagatgcaaacccaacgacatggatttctttcattacacactgtagggaggggagagggttttccaacggatccaaatccagagtgcaatagctcccagcaatagcaatagctacgtcaacagcaagaggtggttgcttcaaagaatggaagcaaacacgagtacaaccacatcagtatatcataagtggcttcttcaaattcttcctataacagccaagcgggaaataaataatgtcaaataaccaatgattatggccattgtgcatctgcttatgagccgcagcaggcagatcgctgggcagctggtgcctcagaaccctggtctggcttgttaattttgattgccttgtcctctggctttgaatcagtctccgcaagcctctgcttgatgtcacgtgcgatggagaaaaacacttgctccacattcaggtttgtcttggcacttgtttcaaaaaacttgatcccgtactcatcagcaagtgcttgtccttttgcagtaggtacagccctcttgctttcgtccatatcggccttgttgccaaccaaaattttgttgacattatcagaggcatgctgttcaatgttccgaatccagtttcggatgttgttgaaagaagattcatcagtgacatcataaaccagcaagatgcccatagctcctcggtagtacgcagtggtaatagtccggaagcgttcttggcccgctgtatcccaaatctgtagctttatacgcttgccatccaattctattgttcgtatcttaaagtcaataccaattgtggtaataaagcttgtagtgaaggaaccatcagagaaccgcaacaggaggcaactcttgccaacaccgctatccccaatgaggagcagcttgataaggtagtcgtagtcggcccgggccctcgccggcggcgccgccatgccgcccttcctctcctcctcctactacccggcgcgcgcgcccaccggtcccggcctgcgggcgtggggtgcggggatcgaggagcgggcggtgccggatctgggggcgggttgcgcagggaggggggagcgagacgaggagacggcaaattttcggggggtaaataaatcgggtggtggtttgattcgccgggcgcatgagcgagcgtgtgttatgttatgatgggtcagtcacttgcatcgg

SEQ ID NO: 287 - DNA, 1385 bp, Saccharum
caaacgaacacaccgccaccgtcaacaacaacaacaaggtcgcggaggtgggtggcgccagtcgtcgccacggttgcgccgctctcggccttgctcgcctgcggtgcggcagtgatgctcctgttccggcgacaaaagaggaggagcgccaacgcaattgatcactccgacgacgaggacgacgacgaccgtgaccaagcagatttcgaaaaagaggtgctcgggcctaggaggtaccactaccgcgagctggcggcagcgaccggcaacttcgacgaggagaacaagctcgggagtggcggcttcggccctgtctaccgcggctacctcgcggcgcaggaccgccacgtcgccgtcaaggtgctgtcgccggagacctccacacagggccgcaggcagttcgaggccgaggtccggatcatcagccagctgcggcaccgcaacctcgtccagctcgtcggctggtgcgagagccgcaaggcccgcctcctgctcgtctacgagctcgtcccggagggcagccttgaccagcacctctacggcgcggcggagcgcctcctggcgtggccggagaggtacaggatcgcggtggggctcggcgccgcgctggtgtacctgcacgaggagtgggagcagtacgtggtgcacggcgacatcaagcccagcaacatcatgctggactcctcgcacaccaccaagctaggcgacttcggcctggcgcggctcctcgaccacggcgtcgggccgcgcaccaccagggtggtgatgggtaccatgggctacatggatccggacctggtgaacacgcacaagcccagcagggcctccgacgtgtacagcttcggcgtcgtgctgctggaagtcgcctgcggcaggccggccacggacgagctgcccgacggggagacgctggcactgccggagtgggtgtgggagctttacgaccgcggcgccgtgctggaggccgccgacggtaggctggacggtcagttcgacgtgtgggagatggagcgcatgctggtcgtagggctctggtgctcgcacccggtgcccagggagcgtccgtccatcgtgcacgctctcaatgtgctgcagtcccgggacaccaccctgccggccctcccgacgaacgtgcatcgtggcgcagtggcgccaacagctgggttcagtgcgtacgttcactctatgtcgtccgtcggtagcgttggagaaccatgctgatctgatctcatactagtgccacccaggatctaaaagcgtatactagagaagagactcgttttctttattgtctactgcatttaactattttttaaaactgtttgcttcgctgaaatttagtttatgctgatacttatgttaaaatgatgtgagagaaaaacact

SEQ ID NO: 288 - DNA, 537 bp, Saccharum
cgctgttcctgcagcagaatctgctctccggccccatcccgtcgggaatccagaggctcggcggcctcgagcgcctcgtgctctcccacaataacctctcgggctctatccccttcgcgctcaacaacctcaccgcgctgcgcgtgctcaagctcgacagcaaccacctctctgggagcattcccagcatcagcatcgcggggctcagcatcttgaacgtctccgacaataacctcaacggctccatccccaaatcgctctcgcacttcccgcgggacgccttcgccggaaacctccagctctgcggggagccgctgccgccctgcagcagcccattctttcccccagcgccatcgcccgggcttagcccgggcggcggtggccccgcgccgggctcctccaagaagcggaagctctccggggccgcaatcgcgggccatcgcgtgggcgccgtggtggtggggcttctcctcctcatcggcatcgtgctctgcacggtgtccaaacgtcggagcgccgccgcccgcgaggggccca

SEQ ID NO: 289 - DNA, 1340 bp, Saccharum
gcgccgatgcccgccgtcgcccatatccgcaacctcggccatggagaggagaccaatccgacgcccgacatcgtggctgcgcacctcgccgccctccgccgctcctcctcgcctccctccgccgacgccggcgcaagatcgccgccggactccgctcccctgcttcgttcccgtcctaatggggggggggggtcgctgtgcgcagacagttggcttccaccaaccccacgttgccagcagcagcctccacttgctccactcgaccactccacccccttccgccgccgggcgagacgcgccgtgcgtgctggacatagacggcgcggccaccgtggcaggcggcgtccaggacacctacggcgaggaccgcgccaccgaggagcagctcgtcacgccctggaccgtatacgtcgccaggagagaaagatcatgaataatatccgacaataccagttgcctttgcagcgctacatggccctcatggacctccaggaagggaatgagaggcttttctacaagctgctcatcgacaatgtcgaggagttactaccgatcgtctacacgccaaccgttggcgaggcctgccaaaagtatggatccatatttagtcgccctcagggtctttatatcagtttgaaggagaagggaaagatccttgaggtgctgaagaactggccagagaggagcattcaagttattgttgttactgatggtgaacggattttggggcttggagatctcggatgccagggaatggggattcctgttggtaaactttccctttacactgccctgggaggagttcgtccatctgcttgcttgccaatcacattggatgttggtacaaataatgaggagctgcttaatgacgaattttacattggcttgagacaaagaagagccacgggccaggagtacactgattttctgcaagaatttatgagtgctgtgaaacaaaactatggggagaaagtgctcattcagtttgaggattttgccaaccataatgcttttgatctccttgcaagatatggcaccactcaccttgtattcaatgatgatattcaggggacagcttctgtggttcttgctgggcttattgcagcccaaacattacttggtggttcattggcagatcacacttaccttttcctgggtgctggagaggctgggacaggtatcgctgaacttatagctcttgagatctcacgtcagacgaaagctcctatagaggagtgccgcaagaaaatctggcttgttgattcaaagggcttgattgtcagtacacgaaaggagtcccttcaacacttcaagaaaccatgggctcatgagcataaacc

SEQ ID NO: 290 - DNA, 1222 bp, Saccharum
  misc_feature 508: n = A,T,C or G
ccgccgccgccgccgcctgccaggagggccccctcaggctcggcggcaggcataacgggagcggaggcggcgctccggccaaggacgcggcggatgcacgtcgacccccacctcccagaagcagtgcctactagatccagcgtgcggggccacgacgatgacaacaacggtgctgtgaagcaccaagacggaggaggagacggctccggctagctcggccatcttccgatcttgacaggtctagagttcggtgatccacacactcgagaaataagatgttttgcgtctccaaaaacaagaaccctcggatttcaaatggcagcagacgcagtgcctgaaattacaactcgacaaggttctatagatgcagcaatgtcaaattagttgtcggatgcacccatggtacccagctaatatgcttccagcatactactatcttggcctgcaatgtgatagtttcctgttacggttaagtttgtgtggttggatattttaaggatcttattanatgtgtccaccctattttggtatatggcatgagaaccggaagaaatagtagaactagcagaaatattggcatttctagcctgagatttcttctcctactctcttagtgaactattattcagaaaacttcaattgattgtttcatctatctgtaccagatgctgccaatacatgtaagggacagattttgtagctacactacagtttttctattactgcgttgaaattaatttgttgatctatcacttatttttgttctttggaagctaaaacgaattcaggttgtcttttgaaaaccaagatgatagtggagggttttccagtggtggagaaaaaatcctaaatatccagttattgcattggtaagtttggcttgtgcattaattagcccaagaatagactgtgacgaggcttcacaattctgggccggtttagttccaaaattttttgcaaaatggcactgtagcattttcgttgttatttggcaaatattgtccaatcatggtctaattaggcttaaaagattcgtctcgtccatttcgtctaaactgtgtaattagttttattttttatctatatttaatgcttcatgcatgtgtctaaagattcgatgtgacggggaatctgaaaaattttgcaaaattttctgggaactaaacagggccagaatgtgaatattactaaaaaagcctttcattctagatgaaataaacaa

SEQ ID NO: 291 - DNA, 1585 bp, Saccharum
gtcgacccacgcgttcgaccacaccgcctcctccgcccagccacctgcgcccgccgattcgtcgagctcgcctcgcgccctcgcccgctcgcctagctccccctgcctcttcttcccttcctccccacctcctcccccgcgaccgtgctcctgcatgccagcgcgctgaccggccgacgacggggtcggggtgggcatcatggacaaatcgacgagaatgtgtaccgcgagatcgtcaaccaccggtcgctgcggcacccgaacatcattcagttcatagagggaaaaaactctgcaggtgatcctaacaccaaggcatcttgcaatcgtgatggagtatgcagctggtggtgaattatttgatcgaatcgtcgatcgtgggcgatttagtgaggatgaggccaggtatttcttccagcagttgatctgtggagtgagctattgccatcacatgcaaatatgccatagagatttgaagctggagaatgttctcttggatggcagcccagctccacggcttaagatatgtgattttggctactccaagtcatcagtactacattcaaggccaaaatcagcagtggggacgccagcatatattgcaccagaggtgctttctcggcgggagtacgatggaaagcttgcagatgtatggtcctgtggagtcactctttttgtcatgcttgtgggagcctatccgtttgaagatcaggatgatcctaaaaatattagaaagaccattcagcgaatagcagcaattcagtataatatcccagacaacattcacatatctgatgattgcagacagctcatttcacgcatctttgttagcaatccattaaggagaatcaccatgagggaaataaaaaaccatccatggtttctaaagaacttgccgagggagctgacagaagcggtgcagttatcctacttcaggagggacaacactgtctctgctttttcagagcaaacaaccgaagaaatcatgaagattgtcaaggaggcaagaaccttgccaaaatcattgagatcaggctatggctacagtgaagaatgctcagatgaggaggaaaaggaagaggagagtgaacccaaagaggaggaggaggaggaagatgagtgtgataagagggttagggaggttcgcgaaagcggggaactggatatgacctcactgcacatctaaatgctgcctgtgacgtgtctgaatgtagataattggcataattgtctgctgaatttggtagaatgtatgcaattctggcgtcagatatagtagtctatttaagccttctccactctgtaatatatttgttttgttgaactgtatgtgtggtatatgggtttgttctaaaggagcaaggttttgtacaggcacacatgattgtgtttttggataggaagttctaccgtttgtttgcactctgcagcaaacattttggagtttgtaagccatatgttggggcatatccagtaaaaatggatgaaatgctgcagattctgtcagaatgaggacctgtttggtttgggtgttaaagtttaacaaacactgtattactttcgtcttatttgacaaaaagttttc

SEQ ID NO: 292 - DNA, 556 bp, Saccharum
tcaaatgggaaatgtcaatttggtggttgctggtcattttcatgtgatgtttgcctacatctagatgtgatgttgttttttttacgaccatgccacatataggtacatatttcattaagaggaattagaggtacattacaagttacccactcattggtaagcgccaagcttaccagagagaaggagaacaaaaaacacaagaaagaaagaagaacaactgaaacaagaactgagggcgaaaaaacacaagcctaaagacaacctcgactccctaaccagacaacaacgcgcaaggccgctcaacctgcgcaccaagcaacataacaggttctgtgtgacgatagggagagacaaacttgcgataactgatggctgcgttaacaccttaatgcgtctacggcaggagcccatctacctctaggatgtgatgttgtccttcgcatcgcttctattggaacaattatcctctcggcttccagtttcagtagagctaatgatttaggttttaattcagactgtgactaaggtgttggctaattaacttcagttaacaatg

SEQ ID NO: 293 - DNA, 1304 bp, Saccharum
cgctggtgaggaggtcggcgacgtccttcttgaggaacttgaccatggcttgcttcttccgccgcagcagatccagccgagtccgggtgcacttgattgcgtgcttgcatttgttgtagaacttggagttgagcaaactgtcaaacatcttgcccgctccctcggtccccctctcctgcgcttctccctgttctcttcttcggttcttctcctgcagctcctccccctgctttaaccagtggcagaggagatggtgggaggcaggcagaggcggccaaagctgcgagctgtggcgtcaaagcatcagaaagagaggagaaaaaggaagaagagagagagagagagagagagagaagagagaggtggtggtggtggtggtggcggcctggtggggtgctccccggcagctcctcgccttcggtatccacctctcctacgttcgttcacatcgagccccagcgtccgcgactagccgagacccgagactacctccgcaggaagcacgatatatacaataagtagccggagacgacgatggccctcgctccagcgagctccggcaaagaacccgtgatcccggaggtggagatgaacggcggcgctgaccagcccgccgccacagtgcgggccaccgtcgtccaggcgtcgtccgtgttctacgacacccccgccactctcgataaagcggagaaattcatagcggaggcagccggaaacggttcacagttggttttatttccggaagccttcattggtggctaccctcatggatctacatttggactggctattggcaatcgcactgccaagggaaaggaagactttcgcaagtatcatgcagctgccatagatgttcctggcccagaagtgtcccgcttagcctcattagctggaaaatacaaggtgtttctggtgatgggggtgattgaaagggcaggctatacactctacaacacggtgctcttcttcgatccacttggaaaattcctagggaagcaccgcaagctcgtgcctactgcactggaacgtgtgttctgggggtttggagatggatctacgttgcccgtcttcgatacccagttgggaaaaatcggtgccctcctttgctgggaaaacaagatgccacttgccaggacagccatgtacgccaaaggtattcagatatattgtgctcccacagctgatgcgtccccaacttgggtggcttccatgacgcatattgccctcgaaaggggatgcttcgtggtgtcggcaaaccagttctgtcgcagaaaggactaccctccccctccggagtacacatt

SEQ ID NO: 294 - DNA, 825 bp, Saccharum
ctttttctgccatctgaatcattagttgaaacgactgtggcgccattttgtacactgtcgccagcacttggacagttcggcgcctcctcaattactgcacattttttcttgcaactagcaatgttacaatgcttgcgcaaaactgatgtgccgtgactaaaaacaacatgtgtgccacagtcaatgcacttcgctgtcgcagactgtccatttactgctggtgtaatgtgaaaatagtcccgctccttggattgatttttgcagccgtttttgtcggatataccagcagtattggcggatgcatctacgtgctctgcttcatctccaaccatgccttccggttcaatagcaggagcaagcataacaatagtattggccgatccatctacttgctgtgctccatctccaacaatgccttccagctcaatagcaggagcaatcataactccttcaacctgttgctggagcctgcagtagtcgagctcatccaccacgtcatcggcgtcatacatgagctctttgacacgagcgagagagcgggcaagcggcttgttcccgacagccctccccttcacaccattaactaccgtctccatcctctccacctgagacttgagttccccgacggcaccagcgaggccaactcgatgaagccacgcgtcgagctcgctgggtagaagcgattcaaggatgctttgcacccgccatacaatcgcagactccacagccgtcgcctccgcctgctccatcagatctgaccgaagcattgttctgagcggtggtcaacggaggaggaagcaaaagagaggaggaagcaaaagagag

SEQ ID NO: 295 - DNA, 1550 bp, Saccharum
ctcccatcccggcaccgcgtctcctcctcggctcctccctcctttccatcccgcttctatcgctgcctccatctccaggccgcgtcgaattcctccgtccaccgcgccggtccggtcgccgaggaggaggaggatgctgggcgccgcgaggaggcagcttggatccggtcccatgctgggacaggttttgcgaaggctccgcccagcggcggcggcggctgaggtggcgaggggctactccgctgcggcgaaggagatgactgtccgtgatgcgttgaattctgcactggatgaagagatgtctgctgatccttctgtttttcttatgggagaagaggttggagagtatcaaggtgcatacaagatttctaagggcttgcttgacaagtatggtcctgatagggttcttgacacacctatcacagaggctggctttactggcattggtgttggtgcagcttatcatggtcttcggcctattatagaatttatgacatttaatttctcgatgcaggctattgatcatatcatcaattcagctgccaagtcaaactatatgtcagctggtcagatatctgttcctattgtttttagaggaccaaatggagctgctgctggagttggtgctcaacactcacagtgttatgcagcttggtatgcacatgttccaggacttaaggttctcacaccatactcttcagaagatgcccgaggcttgctcaaagctgctattagggatcctgatcctgttattttccttgaaaatgagttgctttatggtgaatctttcccagtttctgctgaagtgcttgattctagtttttgcctaccaattggcaaagctaagatagaacgcgagggtaaagatgttaccattactgcgttctccaagatggttggctatgctctccaggctgcagagatactgtccaaggaaggaatcagtgctgaggtgatcaaccttcgatcgatcagaccacttgacagagctgctattaatgcatctgtcaggaaaactaaccgattggtgactgttgaagaagggttcccccaacacgggattggtgccgagatatgcatgtctgttgtagaagaaagctttgagtaccttgatgcaccagttgagaggatcgctggagctgatgtacctatgccctatgctgccaaccttgagagaatggctgttccacaggtcgatgacattgtgcgggcagcaaagcgggcctgctacagggcagtaccaatggcagcagctgcctgattggtggacaagcctttctgttttccttccctcggctttcgctctctagccagagaacatgtattcataaggtgcaggcaaattggccggaccccagactccaagcgagctaattttgtagatctgtcatggtgttatttattccgttagtcgatatatgctgcattctttctactttcaagtccatttgcttttctatgatttctacagacggccaaataatcttgttaaggccctgattgaatgcaaagtatcttttggagtaacatgaagtgtttggaagcaacaa

SEQ ID NO: 296 - DNA, 1692 bp, Saccharum
cccaggaagaatcgctctcctgaatcgatgaaattcaccaccaacaagtgtttctttcttctcccgttcaccgcacctggcccgagaccgagacacgccggaccgccgccgccctattcccagctgcccaggtctcgtcgggctcgagccctttgccggcgacgagcactcaccacaccagggagtaaccatgtcttcttcaatggaatcatcataccttcctgctacaactgagtcattagccaaggctcaagaggctaaggatgcttcagagtccatttcaatcctttaccgtgtcattcaggacccatcttcttctgctgatgcactgagaacaaaagaagttgcaattacaaatcttacaaactacctcactaaagagaacagagctgaggagctgcgtaatcttttgacccagctcaggccatttttcgcagttattcctaaggcaaagactgcaaaaattgtccgtggaataattgatgctgtcgccaagatacctggaacatctagtcttcagatttcactctgcaaggaaatggtggaatggacccgttcagagaagcgtactttcctccggcagcgtgtagaggcgaggttggcggctctcctgttagagaatcaggagtatactgaagcacttaccctccttactagtcttatcaaggaagtcaggaggcttgatgacaagttacttcttgtggacattgaccttctggaaagcaaactccacttttccctgagaaacctgccaaaggccaaagcctccctaactgctgctagaacagcagcaaatgccatttatgttccacctgcccagcaaggcactattgatctccagagtggaatcctccatgctgaagaaaaggattacaagactgcttacagctacttctttgaagcatttgaagctttcagtgcactggaggacccgaaggccatcttcagcctgaagtacatgctgttgtgcaagataatggttaaccaagctgatgatgttgcagggataatctcatctaaggctggcctaaaatatctgggtcctgatgttgatgctatgaaggctgttgctgatgcatactctaaaagatctctcaagtattttgaaactgcccttcgtgattacaagtcccagctggaggaggaccctattgtccacaggcatctttcttctctgtatgatacactcctggagcagaatctctgcaggctgattgagccctactcaagggtggagattgcgcatatagcggagatgattgaattgccggtcgaccatgttgagaagaagctgtcgcagatgatcctcgacaagaaatttgctgggactctagatcaaggtgctggctgcctcattatctttgaggatcccaagacggaggaaatcttccctgccactctcgaaaccatttcgaatgtcgggaaggttgtggacagcctttacatgaggtcggccaagatcatggcttgaaagcagctagtcttacctgtttgctctgatttcattttcagttctgtcgatgccctcagacatttagtccttcatcaatatatgacagtttattgtgcatgttccctctcaatttagttcaacaaaacatactatcttgcttgctacatactgctaagaacaagacagtttgctgtttctgcgtggtgaaagtactgtgaacacttgctggtcccaagcat

SEQ ID NO: 297 - DNA, 2278 bp, Saccharum
ccctccctcgccgcattccccttccgttcacggtacactcacgcacccctctcgctctccgagactaggacgattggtgtttcgcccccctcgccctccgacgactggtggtccgccggcgccggcgccgccctacgtaaggtgccggtctcttcgccggcgacgagcacccaccagctgaaaaaaaaagttctagccaaacataataatggctatgattgatgaacctctgtacccgattgctgtactgattgatgaactgaaaaatgaagatattcagttgcgccttaactccatcagaaagctttctacaattgcccgggcattgggtgaagaaagaacaaggaaagagctgattccattccttagtgaaaacaacgacgatgaagatgaggtgcttcttgcaatggcagaagagttgggcgtttttattccttatgttggaggtgtagagcatgcacacgttttgcttccaccactggaaacattgtgtactgtggaggaaacctgcgtcagagacaaggctgtggaatcgctttgtcgcataggagcacagatgaaggaaagtgatattgtggactggttcgcccctgtcataaagaggttggcggccggcgagtggttcacagctcgagtttcgtcatgtggcctttttcatatcgcttatcctagtgcacctgaacaactgaaggcagaactgaggacaatttatggccagttatgccaagacgacatgcctatggtacgaagagctgctgcatccaatcttggaaagtttgcttcaacagttgaacaaagtcatttgaagacagaaatcatgtcaatatttgatgatctaactcaagatgaccaagattcagtgcgactattggcagtcgagggttgtgctgctcttgggaagttgttggagccccaagattgtgcagcacatattctcccagttattgtaaatttctctcaggataaatcttggcgtgtgcgctatatggtggcaaatcaactgtatgagctatgtgaagctgttggtactgagcccacaaggggtgatctggtgtcagcatatgttcgtctcctctgtgacaatgaggccgaagtgcggattgcagctgctggaaaagttacaaaattctgcaaaatattagacccacaaattgcaatcgaacatattcttccatgtgtcaaggaattatcatcagattcatctcagcatgttcgttcagctttggcatcagttattatgggaatggctcctgtattgggaaaggatgccaccattgaacaacttcttcccatttttctttctttgctgaaggatgagttccctgatgttcgactaaacattataagcaaacttgatcaagttaaccaggttattggaattgacttgctgtcgcaatcacttctaccagccattgtagagctcgctgaagataggcactggagagttcggcttgccataattgagtacatacctttgttggccagccagttaggtgttggtttttttgatgacaagctgggggcactttgtatgcagtggttggaagataaggttttctcaatcagagatgctgctgccaacaatttaaagcgtttggcagaggaatttggccctgaatgggcgatgcagcatataattcctcaggttttggagaagataaacaacccacattatctgtatcggatgaccacattgcaagctatttctttgctagctcctgtcatgggtcctgatatcacatgccaacagttgctccctgttgtcattgcttcttcaaaggacagggttccaaacatgaaattcaatgttgctaaagtcctgcaatcacttgtaccaatccttgatcaatctgttatggagaaggcggtgaaaccatgcctagttgagctcagtgaggacccagatgtagatgtaagatactatgcacaccaggcccttcgggcgtgtgaccaaatggtgatatctagctgactagcctgtccagaaattagcaaatgagatacccattggtccatttttttgaatattttaaagtgttctgtagtcttataaattattctaccaccaatggctttgatgcaactttttattaattatgtgtttttttatttaggtttagtttagtttttggttttaatcaaccttggggaagtaggtggacatgatatttgtgtgattgacttgtgcatgtcttgtactgctacttggttggtcactacgtgtaagcacattgttttgtagtctgctttgcttagtctggttgtgcgcggaaactgt

SEQ ID NO: 298 - DNA, 1167 bp, Saccharum
agtaatgcatactttttcctctctgtaaccagtacgcgtttcatagcagtttttttttgggtctcattttacaagcaaaacgagtttgctggctgctgtcccgttccaagttacagaccagaagggaaaacagagagagagagagagagagagataggaacagagtgagcgagagaaatcactaactactagcgacgacatctttcttatctatgcttagccttgccttgctccgaagataagggtaacaaacaactgggaactaacatgaggtcagaaatcatcataatccggtcgccgccgcaggttgatggggtatcctttgagggtccgggtggtggggaagaagacaatcctgtcctcctccgcttcttcccagctgaagcgcgtcacgagatggtggagaaaaacagaaaccaccacccgggcaagctcgtagcctgggcacaggcgaggtccgccgccgaagggggtgaacagactcgccccttccgcgttctgaagcttattcttgctctgccatctccaagggtcaaaggtccgagcattctcgtagtgttcgaggttaaggtgcacagctcggaacgaagcgaatattttgcagccctttggaataacgtaatctttaaaatgaatatcagtgtttgcacgcctgaacaccccgctaattaagttagccacacgcagtgtttcacttatcacacattgtgtaaatggcatcgacttgtaatcgccccattccagaggttggtctttgccttttatgcctctgatattatcatgctcttccttcagctgcgccagtgcagtgggcgtctcggtgaggaacttgacggcgagcgtcatgagcacggaggtggtctcgtagccagccaccagcagagacaggcagaaatccaccatctcctccacggagaagctcccaccctctgcttcgagaagctcctccaccatgtccttcttctccctcttctcctcatcctccccatttttactggcgccactggtttcagccttctcgtccatcctcttccttatcacctcccgaagagctccggccaccttcttcctcgctcgcggcggacgctctcggtccatggcccgggctcgatgctaacgagctgccagacggtgaggttgaaggtgatcttcttggcctcgtcgagg

SEQ ID NO: 299 - DNA, 721 bp, Saccharum
tccggtgccggcggcgaccaattgtgtgctcggggaggcgatcgatctctcaccatgtcctcggagaaggaggcggcgctcgccgccttgcccaacgacagcccaaccatatttgacaagatcatcaaaaaggaaataccttctactgtggtttatgaggacgagaaggtactggctttcagggacataaaccctcaagctccaacgcacatcctcatcatccccaaagtcaaggatggactagctggcctgtcaaaggctgaagagaggcacgtagagatacttggctacctcctgtatgttgccaaggttgttgcaaagcaggaaggacttgaagatggctatcgcgttgtcatcaacgacggcccaagtggatgtcaatctgtttaccacatccacgttcatctcctcggaggcaggcaaatgaactggcctccgggctaataatatcttgtgattgatcagtcttcatggcaaggattgcttctccatttctctagaataattcctgtaatttccataaaagctagtgcgctgaccttgtgctatatttgtggaattgccggaagcatcatgctgtgatttatgaacacaagaaacttgtacttggtatcgtggattgactcatctggtggaggttgtccactgtccttgttgatctgctcaatcttctcgcctgtcaacatttttatcttccaacaagtagcttcgctacctacat

SEQ ID NO: 300 - DNA, 916 bp, Saccharum
agccaaacaagtatttactgtgctccccccaaaaaattgatgtatgtactgtgtccgagtatataccatgaagagatctctggtctctcaacaaaaaaacaagaaagattcaatttacacagttgctacctaccagataacaagctactaagaacaagaagacgcgtaactacagtaactttgggggtggaggtccggaaaaatcaggttgagcgtatgacagcctctggatccagttgccagacttcttcttgttttgatcattgcattccaggggctggcagatcgagattgggatcttgtcgagtgttccatcagtttcaagagctgtcttgaagttttcaaggattgaaactatttgctgaaactcgggcctcttttctgggttccaggaccaacattgctcaatcagaagcttcagagctgctgggcagctcaatggaatagccggtctcaagttcttattaacccctgcaaaagctgcctgaagcggagtcatatcttcataagggagtgaaccagtgaccaattcccacaagagaagtccaaagctataaacatcaaacttccggccatatggcttgtgcttgtacatctctggtgccatccatctataagtacctggatcatcccctaacaaattgcagtatgtttcttcgcatgccactccaaaatcgacgaccttagcgcagaattctccatcaaataagatgttctcgggtttgatgtcacggtgcacaattcctttgaggtgaatatattccaggccacgtgcgatatccaaagcgatggaaatgaccttctccaaaggaagagttttacgctccagctttcgcaagaaagccctcaaagaacccccacccaaaaactcagtgatgacacagaagaccggtgggcaattacacgctccaacaag

SEQ ID NO: 301 - DNA, 1431 bp, Saccharum
acatacaacaaagatggaagcacaccataattttatgtacaaattattcaaaagttctgtagattaaaaagcgtatacagctggtgataacttggctacatccaaatagcgtgtagcatgcgtagcaagccaaacataaacttacagcaagcatcccgttgccgcttcacatctttgctgccttcgatatataaaacagcacacagatggagcatatattactagcaggcattgtagttctacaatatatgaaatcgccattatcatcagggaagacaactgatcagagtctactccttcgaggtgtggactgcggacacggtagagaccatggagtcgacgccgcacttgttgcgaacattggaacccctgcatatcttgtagtatccgttatccccccagttctcgccccacgagttcttgatgatccagtaaggcttgtccttcaggcggatgggggcaaaaccagctgcgccatagccaacaaggagaacaccatggtcaagggttctgccacagatgtatggacatgacacacctccgatgtatgtctgcatgtaggcagcattgatgccgattgccagtggcccatgtttgatgaggttagcagcaatttgaccctcatccacagacacaacactgaagttctgaactgaagcaacaatcttggacttgtcaaacttgcatttatcatcactcccagtgtaagggtaatccttctcactctcaaggccaccagccttctggagataactgaaggcatttgtcatcagcccaccattgcaacccgaatcacatgaatcaggttctgatgaatcacacacgtggtcacagtcgaccatctgctgctcggaaagcacctccagcttgccagttgcgaggtagtgcgcaccctccagcgctccagacgcgctgaacgaccagcacgagccgcacgaaccctggttcttgacgggggtgacggcgccgtggtccctccaatcgaagtcgtcgggcaggccatcggtggggagaacaggcgcctcgttcgccgactccccgagctctctgaggagcgcgcgccgggacttacggaggccgaggtaggtccggcggaactcggccggcgtcaggtcagagaacttagtgacgccgtgctccgccgacgggtccagcagctggtgccggcgcgcgcggcgcagattggccttgaagacggacagccggtacgcgtgctcttcggcgtccttgtaggacttgccgaaccgctgcacgaagctcaggaagtgggactccgcgttcagctccagctcgttctcatctccgccgggaaccacctgccggatcagcgggtcctccgcgtcgacggcggcggctaccgcggcgagagaaaggaggaggagaacgcgatgagccatcggggattccttgctagtctggattggcggacgc

SEQ ID NO: 302 - DNA, 1035 bp, Saccharum
agaccggagggaaagccaagcttgaatcctgttgcaaaaaatgatttgcctgatagcaaacttgtattttaatcaccattatttaggcctaggactactacattatatttatgcttaataatacatatctgtgaatgtaataggttgcaaaaaatagcaacagtcaaatcattctaaatacacagacaaaagcagcgctaaaccataggtgaactattctcatggaagccaatttacacctgacaggcagctatcgcaaaaattaacacccgttgtaggtgccttctgttttctgccaataaacatggtacgcaatgcagagacttccctagctgatggatagacacatagattgctgctgtcttagccctttattaggtatccccgttgtggtactgtggctgcatatagcccatcccttggttgtaaactccatgctgaaccaactggttacttgagctactggtgccaccatgggaactgattgcatccttctttatagagccctcgccagcctttgtagacagcttactatcaccctccatctctctgtacttttgtaggtaaatcttcagaggctcgacgtactcctcgaatcctaacgtagccatcgcccaaagcaaatcgtccccgttgatcgtctttctcttctccttctgacatttgtcgctggcctcgctggtgacaaaggatatgaactcggagacgcactcctgcagagtctccttagcgtccttagcgatcttgccgttggccgggacggccttcttcatgatccggctgatgttggcgatgggcaggaatcggtcctgctcccggtagccgccgccgccgccgctgccgccgccctcgtggctcccgccgtcgtccgccatcgccggcgaccgggcgccttcgccgaaacccttataaaaacgcgcgcgcggggaggcgaggaggggagagaaaggggcaggagctggccgcagagggaggaggagaggtggggaatggggatcggacgctggagaagaggaggcgctccgggtgggtgcg

SEQ ID NO: 303 - DNA, 1264 bp, Saccharum
tatcatttctccctccgcttgcatcttgccggcctgtcgctcctgtctccgccgcgttcacaactcaagagccagagcagacgcccatcagaaagccaacgagagttacgagaaatcgaagtcgacctcagctgcgggctgcggctgcgcgcgagcactctattggagcggcgccgtcaatggcgggcctcgggttcgaggagaccgagctccggctcggcctgcccggcggcaacgacgccggggatgccgccgcggcggccaggaagcggggcttcgaggagaccatcgacctcaagctgaagctggagcagccggcggcggcgtcatcggccgcggcgcacgtggagcaggagcaggaggacgaggctggcgctggcgacgttgtcgtccccgccgcggtcgcactgtcgtcgcctccagcagccaccaccggcagcgcaggtacgactatgaagaggtcgccgagccagagcagcgtggtcaccgccgacgcgcagccggcggaccccgaaaagcctcgcgcgcccaaggcacaggcggtgggctggccgcccgtccggtcgttccgcaagaacatcctggccgtccagtcccagagaggcggaggcggaggcgacggcggcaagttgttggcgccgccggcgtttgtgaaggtgagcatggacggcgcgccgtacctgcgcaaggtggacctgaggacgtacgggagctaccaggagctgtccaaggcgctgcagaacatgttcagatctttcaccatcggcagctgcgggtggcagcaggggacgacgatgatgaaggagacgaagctggcggacctagtgagcggctccgacgagtacgtgcccacgtacgaggacaaggacggcgactggatgctcgtcggcgacgtcccctgggagatgttcgtggagtcgtgcaagcgcctccggatcatgaaagggtcggaagccgtcggcctcgcacccagggcgatggagaagtgcaacaacagctgctgagcaagcgtctccagccggtattaattaactgcaacggtggataatgtattattactgcttctgctcctctctgtatcatactgttgtttactaccctgaactcctgaaggtctgcgtcatcgtctctttttttcttttattttatggactctccattccatgtatcatatattgcgtcgttaagtttcatcttgttatatgtatatatacacaccgtaacaaagatggtgtgatcgatatgtatgtatgtgcccttttgc

SEQ ID NO: 304 - DNA, 608 bp, Saccharum
cggacgcgtgggtcgcaatccccctcttctccatggcggaacctgtgccacccaagaccatcaagcaccaagacatgtcctggaccgtctgggaccgctggaccgtaactggcaacatcacgctgagagagctcctggagtggctcaaggagaagggcttgaacgcatacagcatatcctgcgggacctcgctgctgtacaactccatgttcccgaggcacaaggagcggctggacaagaaggtggtggatgtggccagggaggtggccaagttggaggtgccttcgtaccgccgccatctggacgttgtggtggcctgtgaggatgacgacgacaatgacgtcgacatcccgcttgtgtccatttactttcggtaaagaggggctcgctgcctgtttacatgatcctgcgcgatatttgtcagaaggatctgagtgtaaaagttgcgatgcaaccgtgaactagactgtgtttaagcacatactgatgatttcccgggctaccacctgggtagagttggctgggaattgttgctgagatttgggttcaccgtttaaaaaaaaaaaaaaaaaaaaaaaaaaaaaaaaaggggggggcggacgcgtggg

SEQ ID NO: 305 - DNA, 2408 bp, Saccharum
tcggaacagcatcaggggtcaattccggcgcctggagtcaaccggccgagtcgaccaccacctacgccttcacacgcgcggcggcggcggtggtggaggtggagcagcagagcagaagacgatgatgagggaagcggcgtgaaccaccgaatctcgcggtcgcggacggagcggcggcgcgggcgagcgagccctggtctctcctctctctctgcgtgcaagctttccaaggaactcctctgttgctacagtaataatagaagaaaaatggagctgctcaacattattctagttatagcatctctgctcccattctcagcatctgatcgtcaaggtgatgccttgtacgatatgaagctgaaactaaatgctactggcagtcagctttctgattggaaccaaaatcaagttaacccctgcacttggaattctgttatttgtgacaataacaacaatgttgtgcaagtaacattggcttctatggggtttactggagttctgtcaccaagaatcggagatctggagtatttaaatgttctgtccttgcctggtaacaacatcactggtggcataccagagcagtttggcaacctctctcggttgacaagcttagatttggaagacaacctgttggttgggccaataccagattctcttggcaggctttcaaagctccagcttctgatactaagtcaaaacaatctcaatggctctattcctgatacactagcaagcatctcaggcttgacagacattcggctggcttacaataaactcactggtcaaatacctccccagctgtttcaagttgcacgttacaatttttcaggtaataacttgacctgtggagcaaacttcctccatccgtgtgcctcaaatatgtcttaccaaggttcttcccgtggttcgacaataggcattgtgcttggaacagttggaggtctgatggggcttctaatcataggggctatattcattatctgtaatggaaggaggaaaaaccatctacgtgaagtatttgtcgatgtatcaggtgaggatgatcgtagaattgcatttggccagttgaaaagatttgcatggcgagaattgcaacttgcaactgataatttcagtgagaaaaatgttcttggacaagggggctttgggaaagtatataaaggagcacttccagatggcactaagattgctgtaaaacggttaactgattacgaaagtcctggtggagaggctgctttcttgcgtgaggttgagctgattagtgttgcagttcaccggaatcttttaagattgattggtttctgtacaacacaaacagagcgcctacttgtttatcctttcatgcagaatcttagtgtggcctaccgtctacgagaatttaaacctggggagccaatattagattggtctgcaaggaagcgagtggctataggcacagctcgtggactggagtatttgcacgagcactgcaatcctaagattatacatcgtgacgtcaaggctgccaatgtcttgcttgatgaaggttttgaaccggttgtcggtgatttcggcttggccaagcttgtggatgtacagaagacatccgtgactactcaggtccgtggaaccatgggtcacattgcccccgaatatttatccactggaaagtcatccgagagaaccgatgtttttggttatggcataatgcttctcgagctagtcactggtcagcgtgccatcgacttttcacgtttggaggaagaagacgatgtgttattacttgatcatgtcaagaagctgcaaagggaagggcatctcgatgccatcgttgaccgcaacctgaacaacaattacaacgggcaggaggtggagatgatgatccagatcgcgctgctctgcacgcaggcttcgcccgaggaccgcccgtccatgtccgaggtggtccggatgctggaaggcgagggccttgcggagaggtgggaggagtggcaacaggtggaggtgacgaggaggcaggactacgagcggatgcagcagcggttcgactggggcgaggactccgtctacaaccaggacgcgatcgaactgtccgccggcaggtaacgacgtcgggtcccacggagcgtcagcttgtcgtcgacgtcgcagcgctgacatgtaatactatgtatgtaaggcattgttgcaaagcttgtgttagcaaaatttgtgccacttggtgttgatacgtgcctgtattttattatgtgtatgaggatgatttaaaggggttcaggtgttaaccagctcgatcccaccctgtaatctgtaggagggggaaagctgggaacacgcatgtgccgcccggttgaaaccacatcacatgcaagctgcaagcatcggcttgacgaagtcgagtcattcatctgctcgacctgttcagattc

SEQ ID NO: 306 - DNA, 1187 bp, Saccharum
taatctcaaagatctccgtgtcaaactgaaggacaccattcctcccctccttcatcccttgaatcttgacaatgccattacccttcttccttatcctgagattcagtgcttttgcaacctcttcaagctttgagatgatggtcaaggcaggcttatctgaagtgaaccttgtctcctttctgcactcctttttgataaatagaccagacaggtccaaccctgttgagaatgagataatttcgaaggcatttaggtttgtggcagccagtggcttcatatcttcgtgagcaatcttcttgcgccttgtaacaagcactggggcagcatttgtggtggcattctcactaagaattttctcctttactgcgcggatctccccaggaccctttcggaaccaagtagactcttttatcttctgaattgaaattcttgtgctcgggttggggtccagtatcttgtacaacagcttcttgagcttgtgtgaaaaccaacttgggcacctgaaatcaccatgctgtatcttccgatatatctccatcaagtttgggccctggaaagggagatagccagcagcaagaacaaacaggacaacaccacaagaccagatgtctgattttgcaccatcatagcctatcttgctgatcacctctggagctacatatgccggtgttccacaggtagtgtggagcaagccatcttgcctctttgactctgaaagtgcgctcagaccaaaatccgacaccttgaggttctcattctcatccagcagcaggttctcaggcttcaagtcccggtgatacacacctcggctgtggcagtggtccactgcactaatgagctgctggaagtatttgtgtgcagcagcctctgtgagcttgccactcttgtcaatcttgtcaaagagctctccacctttcacatactccatgacaatatagatcttgtttcgtgtcgccatgacctcatgaagatggacaatgttcttatgcgccaccaaccgcattgttgtgatctcacgctttatctgctccgaaagcccgaccttgagcactttgtccttgtccatcatcttgatagcaacgctctggttggactcaaggttccttccatagtgcaccttgcccaacgtgcctttccccagcaatctccccatctcataccgctccaccagagtctttcctctgctc

SEQ ID NO: 307 - DNA, 1965 bp, Saccharum
taaacgatgccttaacatgcatctcacttgacctgtacgctgctcagctttgaattaccattgtgagagctgaaattattcatgtagatagacattaaagccagcaaaagcactgatctagttcactgtatatcctagtgccttcaccagcagccggccagctgtaaagaaccaggagccatctagctccacaaagtctggttcagaagatagccaggcacaacagcttcgcatgtctacaatctacatactccagaaatcaaactactggagatatgattactatttacagctttgtgagcgattcgacattcctctagtgtaatgcaaggaatgcaattgatggaaagcagacacagggaatcaaagaactctcagctgagctagaaaggccgcgcacaagtccagaaagaggagctgtggtccactgactctttgcaagtcgaggaggtatttctcgtctcttgttttgtaaagctgaatttcaaacttaactaaatttaacttctcactttggccatcagtttcaatggactctgcactgaagttatgactgttatgaatttgaccgggaaagccaggactccatctgcacttcatgttatagtgaccaatctttttccagtaaacattcaattcttgcagagctttcagcacttcagtcattatttctcttggatgtgctcgtgactgaagcccaagagcccatttcctctcagctggaaaatgcggtctcaagccaaccggagactccataaatatttgctgtcgattaccacgtgctgaacttggtgtttcatacgatgctatgtttgaaaatgaggagtccatagcttcttgacattcagctccaagatagccactggttgtacgaagcctattgtccaacagtaagtaataagcaacagtcgcctcattttgcagcctgttttggattgattccaccaacaggttcttgtcataccccatacctataacctcacggagagtttcctcatcaatctttttaacttgttgtgcactatctggaggaggcacagtcaaatagcgtgggagatgaattttgaaccaatcatgttcacgaatttcacgaatggtgatccgcttcattgggtcaacaaccagcattcttggaatcaaatcccttgctgcacctgacaaatggctaggaagtgtatatattccaccctttattttcttaaaaaggtttggaatgttctcgtcatcaaatggcaaagtaccacatagaagagcatacagaataaccccacagctccatacatcaacctcaggaccagcatataatttaccagatatcacctcaggagcagcataatttgggctaccacaacttgtcttgaggaaatgcccatcccgcataacattacttaagccaaaatctgcaatcttaacgttgcattttgaatccaaaaggaggttttctggctttagatcacgatgcaccaccatgtttctatggcaatattcaacaccggatataatctgttggaagaaacggcgagcctcttcctcctgcagcctacctttttcaacaatgtaatcaaataattccccagacttaacatactccataacaacataaatatcagctgctgtgtctataacctcatagaggcggatgatatgtgggtgcataaatagcctcaatatcttaatctctcttttaactttctcttccatctccatgcctctgattttacgacggttgaggatcttgattgccaccttgtgtccagtgcttatatgctccgcaattttcaccttaccgaaagagccaatccccagagtcttaccaatccggtaattcctcaaaggattgccatccttgcccgttccctccatcttctgcctgaccgctggaggggaagcggcggcggcggctcgtcaggaggggcgcggcggagatgccgcgagagacgagagggggaagggtgcgaagcgatg

SEQ ID NO: 308 - DNA, 1548 bp, Saccharum
acaaggcaaataaacccagacgttggttcagctgcctctagctccttccctccccgcgcgctgccgcgagagctgagctcggtggagtccagcagggagcaccgcgcgctgccgcctcgttcgtgctgggcatctttgtttttgcttcctgatggggaactgcgccggcgtggaggggaacgccgagatcaacccttccttcagtgcccccaattcttcagggaccggttctaaaaacagcagcaagaatgcaaccgacaccagcacctttggtaccaagacgtccggctcttcgtcgtcggtgccaccaactccccgtacggagacagagatcctggagtcatcgaatgttcgcaagttcaccttcagtgagctgaaaggctccacaaggaacttcaggccggacagccttctcggggaaggaggctttggctctgtcttcaagggatggatggatgagcgcacgcttgcgcctgtgaaaccgggcactgggatgattgtcgcggtgaagaagctcaagctcgacagcttccaagggcacagagaatggctggctgaggtcaattacctagggcagttatcccaccctaatcttgtgaaacttatcgggtactgcttggaggacgaacaacgccttcttgtgtatgagtacatgccaagagggagcttggaacatcatcttttcaggaggagctcgaacttccaaccgctcccatggaacttacgcatgaaggttgcgcttgaggctgccagaggtcttgctttcctgcacggtgatcaggctaaagttatttaccgtgatttcaagacctcgaatattcttctcgactcggaatacaatgcaaaattgtctgatttcggtttggcaaaaaatggtccaagtggtgataaaagtcatgtttctactagggtcatggggacacaaggatatgctgcccctgaatatcttgcaacaggccatttgaccgcgaagagcgatgtgtacagctacggtgttgttcttttggagttgctgtctgggcagcgtgctctggacaagaaccgcccgcctggtcagcacaatctggtggagtgggctagaccttacatcaccaacaagaggagggtcatccatgtcctggactcacggctgggttcccagtattcccttcctgcggctcagaagatggcagccctcgcactgcaatgcttgtcgatggacgcacgatgcaggcctggcatggatcaggctgtgactgtattagaagaacttcaagaggccaagggctcagtgaaaaagctggcaggtaagtagggaggattgctggctacagatgtccactacctcgctggagtctggagcatcctgtaatactttagggaagtaaaaacagagaacggatgaggatctgaagggttgtagcttgtgacgagaatataatattgccttgctttgtgtacagctagttgcttcgtcgttgtaagttgggtctctagtacttatatattttagtagtcttcgttggaccagaggtgcaaaaggtagtttattttgtcccacttcaccgc

SEQ ID NO: 309 - DNA, 615 bp, Saccharum
ctcttcccacgagcgcagacacaaccatacacctactacttccaagcaggggaggcgaccggcggcggagatgtcgggcaggggcaagggcggcaaggggctcgggaagggcggcgcgaagcgtcaccggaaggtgctgcgcgacaacatccagggcatcacgaagccggcgatccggaggctggcgaggaggggcggcgtgaagcgcatctccgggctgatctacgaggagacccgcggcgtcacctacacggagcacgcccgccgcaagaccgtcaccgccatggacgtcgtctacgccctcaagcgccagggccgcaccctctacggcttcggcggctaggttaggtcagggtagttacctgtcgaggcgtctcggatcggtgttactagtttggttaccttcctgtgttcgtctggtagttgctgtagtggttgtaactggttgatttgtcatgttgtgtgcgtctgtaagcaccgctggttcgatggaattggaatggatgacgaagtaggaaagttatccagtttgatttgaaacatgctccaatgttgcgttgcctctaatgggatatctcgcaattggttttcaattgtgcagctttgatttggttt

SEQ ID NO: 310 - DNA, 1231 bp, Saccharum
cgttccactcccagactcccactctccccctaccggctacccccacacaaacagccactcctcacctcccccaccctccggttcatgtcctgctgctccccatgtcgcccccactcgagctcgactacataggcctctcgccggcggcggcggcctccgccgctgccgatgccgacgacgacctgaagggtaccgagctccgcctcggtctgccagggtccgggtcgccggaccgccgtgtcgcggctgccaccactaccaccctggacctgctcccggccaagggcgccaagcgcgggttttctgacgaggcgcccccgccatcgcccgctgccgctgctgggaagggaaagaaggtggcggaagacgaggacgacgacaagaaggttgcagcgacgccgcagccggctgcaaaagctcaggtggtgggatggccaccaatccgcagctaccgcaagaacacgatggctaccacccagctgaagggcagcaaggaggatgctgaggccaagcagggccaggggttcctgtacgtcaaggtcagcatggatggcgcgccgtacctcaggaagattgacctcaagacttacaagaactacaaggacctgtcgactgcgcttgagaagatgttcagtggcttcagtactggcaaggacggcttatctgagtaccgcaaggatggtgaatatgttctgacttatgaggacaaggatggagattggatgcttgtcggcgatgtaccatgggagatgttcgctgactcttgccgcaggctcaggatcatgaaaggatcagatgcaattggacttgctccaagggcagctgataagtccaagaaccgcaactagaatggttgcttcccacagtccagagcaagagggagatccaatgactgtagggatctttatgaaaaaaaaaagtctaacagttttaagaggaattctgccttatggtctgtactacatggtttgctgttacgcaagtaaagaactccacgtctgtcatgttagttttgcaacatcatctatggacaaaatgctatttgattgttgttaagccttcgtaccagtgttattcgtgtaaatggcttggtacattgtgtggtgctactatgattgagcactcctacctagtttgcaaaatagtgtccatgaactgtttgttgttcctctatataaatgttcaatgaagcttgcaaatgtatggtccatctgtgttcatgttctggttc

SEQ ID NO: 311 - DNA, 3198 bp, Saccharum
tgtacgtacgtaagtgtcaaaacaagcacatccgggtgaacaagaagattgccatatacagctccagcctccaaatgttccaaggaaaagcaccatggaaaaataaataaagcaaagaatagctacaggagtccgaggcattttctaagaatcaagcccacaaccatggctgacgctcggatgatgctctaagatcaaagactacatatacagggctggttcggctggtggaaaaaccggctgatttcggctgattcaatagtattatgtgagagagaataagctgaaataagctgaaacaagccgaaacatgacctgcagaacagggcaacaggataaaaagggcgaagattcactaaaacagaagcgttaccaggcagcagagatctatcttgtccacaaatggcaatgcagaaaacttcattgccatgatcaaactgtagccatgcccaacttcggtttccggctgaaattagctctagtttcctacgaagacccaactggtatcatcttcacaatagctgcgataggcatgcctatgaaaccgataaaaatacatgctatccactggttgagcgtaagaggggtggtgtttgcgaaatcaccaaggagctgtattatgatgaactggaagatgacggtgctgccgaggacagcaatgaacacgttgttgtttagaatgccttcaaacacatttatcctctccatctctctcgagctcacctcattgaatacctggcagaatacgaagcaattgaagatcagtgtgttcaagactagatcggagttatcgcccttgattccaaacaaccacttcccctctgtctgtaggtaccaaattacaaggaattggtagaaggcctgtcccaggatgtttctccacataatgttactgatgaagtttcctttccttccaacaggtgttctcttcatcagttcattgtttgggggttctgtagccaatgccagtgcacccagtgtatccatgatcatgttgacccagagcaattgcacagcagtaagaggggcactccctgtcaggcaagctgaggagaagtttaccaccagagcaaccacattgacagtgagctgaaactgcacaaacttctgaatgttgatgtacactgatcgaccccattttgcaacggtaacaatagtggagaagttgtcatcaagaatgatgacatcagcactctctttggccacctcggttccagcaatgcccattgcaagcccaatatcagcctcatgaagcgcaggcgcatcatttgtcccatcaccagtcacagccacaacttcgtcgagtttagttcgaagatgcttgacaagggtatgcttatccagtggcgaagatcttgccatcacctgtatctttggtatcagttgagtaagctcttcttcactcttggttctgaaatctgggccttctatggcaatgccaccttcagttaaaatgccgcattcccgggcaattgcctttgccgtgttgatgttgtcacctgtgaccatcctgacggtaatacctgctgacctgcagatggcaactgattccttcactccgggccgcactgggtctttgatccccacaatgccaatgcaggtgtacccatctgttgggatctgatcattgactgagaacccatcctcaacttccatgtaggcaagacagagagtgcgaagtgcctcgttcgcgaagctatcgattgtggccttcaagtgatcaatggttccttcatccaaggggatgacatcgccttcctcattcaggtacttgctgcaagatgccagtatgatctctgatgcacctttgcagtgtgctcgcagtgcgccctctgggagctggattaccactcccattctcttcttggcagagttgaatggctccacctttacaagggtgcttgctttgcgcactgcggaaaagtctccaccgagtgacagcccgaactccagaatagctgtctcagttggtgtccccagtatttcacgtttgccatcctggttcaagacaacgtcgcccccagtgttgttgaatatggactgggagaggatcgtcatgacagagtctgggagttcggaggacaggctcttggcatctgaagcaccatccacttctttgatcttaccacaaatgcaggctttgacgacagtcatgtggtttgtcgtgagagtgccggtcttgtcactgcaaatggaggtcgctgagcccatggtctcacaggctgcaaggtgccggacgagtgccttgtcgttcatcatcttcttcattgcgaatgcaaggctcagtgtcacggcaagcggtagcccttcaggtactgccacaacgacaatggtgacagcaatggcgaagaactcaagcaactccaatgcgtcatctccagtccagctcaagtatgtgccatcagtgatcttgcgccggaacaggctttcggtgagcaccgcgaatgtgacgacagcaaagataagtcctatcttaccaatgatggtggccacaccattcagcttgacctgcaatggcgtctcgtcatcaccaccttcactgagagtggccatcagcttcccccactgagtcctcatgccgacagtggtgacgagcatcttgcaagaaccgtcctgcaccttcgtccctgaaagaaggaatgggttctcagcattgacggcaactggctcgatctctccagtcaagctcgactcgttgatcagaagcgagaagcctgacatgaacagcccatcagccggcacttgatcaccaatggagaggtgaacgatgtcaccggcgagaagttcatatattgagagcttctgcctgtacccgctccgggtgacctgcaccgtgatcttcttcttctccttgtcgaggtccttgaactgcagggactggcggtagtcgcttgacgctgtgacgaacacgaccagcaggatgctggccacaatgccgagcccgtcgtgcgcgcccttgggccatccctccgtggcgatgccaacaatgagtgagacaaacgcgcacgcggcaaggatcatgagtgtcatgtcctgcaacgcctcccagacgaagaccaagaaaccacgggactccgcctccgcgaacttgttgacgccaaagacatcccgccgggttgctagcttgtccgcggacgtggtgaggccgtcagactccgaagtgcatagcttggacgcgaggccctggacgccaccatg

SEQ ID NO: 312 - DNA, 2086 bp, Saccharum
caatacttagttatggatcagaatgagaatccgaggattagaaagtatgcaacatatcatttcttatatattatatatattcaacttggtggctaatttccaccgctcgctttgtacactatattcatgatcctaatctagaattgcatcaggaacgagcatgttcctcatcccctctgcccaaaaccacatagggaagcaatgatcagaacccagatagagggaacgcttcgccatcgaggctcgaaagatcgtcgctcagtgattcagtcctcataatctgctctgtcttgtaggcccctagctcatccgagagcctctcacacagctgtctgtacaatgtagagtctccatgggatttcctaagttctacgacatataatgatggcccaagctcaaacacctcagtgcacaccaaaaatgatgacggattcctggagttcttggaacatttgctattcttcaagactttgagcttgcttggccccctatggacttcgaatcccatctccatcacaacactctcgaccttgtcaaataaatccttgggtggatgcgttgaagtgaaccgaatctttctttgagctgcatcctcttcctcgaataaaccagaaagatcaagggaagaagccattccgatcaactgaaaagcattgatatgagtacacttttcttgtgctggttcatcaatttgctcttttattgagagaactgaaccgggaaggacgtcttcatcatcatcatatggaacagcaggtacatagtccttcttgaaccactcatgctctctgatccctgtgatgttgatcctcttcatcggatttggttcaaggattcttttaagaaggtcctgtgcggcaggtgagagccactttgggatctgacagtctcccttgaaaatcttctgataaagaacaacaagattcctgtcatcgaagggaaggtaaccaacaagcatcacataaagaattactccacaagaccagatatctgacaaggagccatcgtaacctctgttttgcaaaacctcaggagctatgtaattggggctgccacatgttgtgtgcagaagtccatcattccctagatgttggggtagagcactaaggccgaagtcagagatcttgatgttgcctttcctatcaacaaggacattctctggcttaaggtctctgtggtagacacctttatcatggcagtagctgacaccatcaattagctgctggaaaagcctcctgccctcatgttcagacagttttccctttatagcaatcttgtcgaagagctcgcctccgttaacaaactcaagcaccatgtaaatctttgttttactagcagcaacctcgtgcaagcggacgacatttgggtgcttgagcagcttgagcgtcccgatctccctcctaatctggtcgtcgatgcggagggagaggatcttgctgcggtcgaggatcttgatggcgaagtggccgccggtgccgatgtggcgcgcgtacttcaccttgccgaagttgccttccccgagggtccgcccgatctcatacctccccagcagcgacgcccgcgtgcactccgcccccgccggctcgccgttcaccattcacaaacgcacgcgcgccggattgccgacagaggtcgtgtggccgaccttgctgatccctcaacctctctctctctctctctctgtctgcctcgctcgctggagctgggctctgggatggatggaaccggccagctgaggaacggcggacggatggatgaggcagggagggaggtggagggagagggtggaaggggcggggtacttatagctccgtcctgctcttcttccagcctcagtcgtcgtctactcttctcctcttcccttgttgtctcttgtgttgcaggcagagccttccgcttgcttgctctccgtcgcctcagcctgaggttccgtgcgctgtaaccggatgggcaactggtaaacacacacgcaaaagcttctgtcgacgactgttaattattacggaggattaaacacccccaataggacaaatccacgcgggcttgctgctgctacgtccaccagagcttcgtacctccacaaaat

SEQ ID NO: 313 - DNA, 1268 bp, Saccharum
acctgattgggaacggagggaacagcagggtgtacaggggcagcctcgcctgcgggcagctggtggcgatcaagctgtccaaggcgtcggcgcaggcgtccaaggacttcctccgggaggtggacatcatcaccaagctgcagcacccccggatcgtccccttgaccggcgtgtgcgtggaaggccgcaacctcatctccgtctacagctacctccccaggggcagcctcgaggacaacctacacggggaaaggtcaaagccggcgctgtcatgggagaaccggtacagggcggcgctggggatcgcggaggccctgagctacctgcactccggcagctcgcggccggtgatccaccgggacgtcaagtcgtccaacatcctcctcgcggaagagttcgagcctcagctatccgatttcgggctggccatctgggcgccgacgaacccgacttccctgacgcacagcgacgtcgtcggcacattcgggtacctggcgccggagtacttcatgtacgggaaggtgaccgacagggtggacgtgtacgcgttcggcgtcgtcctgctggagctcctgtctggccggaagcccatcagcagcgacgggtcgtcacccaagggccaggagagtctcgtcatgtgggcaactccggtgcttagcagcggcgacatctctgacctgctggacccgaggctggacgtgaagcacgacgaggtggaggtgaggcggatggcctctgccgcgtcgctctgcctccggaggtcggctcgactcaggccgccgatatcgcagatactgagcatcctacgaggagaaagcacggcgagcatcgccgaccaggacgcaacggagccggactgcctgaacgacgaggcttacccggcggcgaacgtgaggtcgcacctggacctcgcgcttcttgacgtggaagactccgagtccatctctagcacggagcacagcagcggcctcagcccgttagaggagtacctgcgagaacgttggagccgatcgtccagcttcgactgattcgagcctgcgattttgtggtcatgtactttcatttttctttctttcttcaccctcttcaccctgcccccggtacttcacatgtttgttgtatggtttggtcaccgggaccgtgtgtacagtatacagtcaaaaaatcaccaggcctcgtttacttcggtgaattggggagaaaaacactgtatcagaattcctgtagcatttcgtttgtatttagtaaaaattatccaaattttgact

SEQ ID NO: 314 - DNA, 1019 bp, Saccharum; identical to SEQ ID NO: 225

SEQ ID NO: 315 - DNA, 889 bp, Saccharum
aaaccgatcggctgttgccggctggtgtcccatttcgtactgcacgcctccaccgaccgccggtccgccccgatgattgaggctacaagtgggctcaggggcccccgactcctcctgtccgtcgccgtcctcgtcctcgccattgctctcgtcttccgctccctcaccccggcagtcccgcaaatggccgacgacctgcgcacctccatctacgacatcaccgtcaaggatattaggggtgatgacataaaactgagtgagtatgctggaaaggttcttatcgtcaatgttgcttcaaaatgactactcatgttgtaaacaggtcactccagtgtagcaaacttgtgcgttgctgtacatgttttcccctgttcaagtcatagtgtgggctaacaagttccaattacaaagagctaaatgtcttgtatgagaagtacagagagaaaggccttgagatacttgcattcccatgtaatcaatttgctggtcaagagcctggcagcaatgaagatatccaggagacggtttgtagcaggttcaaagcagagtttcctatttttgacaagattgatgtgaatggtaaggacgctgcaccattgtacaagtacttgaaatctcagaaaggtggcttccttggcgatggtattaaatggaacttcaccaagtttcttgttgacaaagatggcaacgttgtcgagcgatatgctccgacgacttctccattgaagatagagaatgacatccagaagcttcttagcacagcatcatgatttggttacatgaattatgttccctgaactctgtatgtcactgtgttgtaatttcattgaaaatatggagcttggacatctgtgtcagtttgcggttctctcagttgaaaattatgatg

SEQ ID NO: 316 - DNA, 965 bp, Saccharum
agacgccagacgccctctacttctctccagtccatttcgaactctctagacgccccctcggtctctctgttcgccgccgccccgtcctcctccctctccgcgccgcagaaatggcgctgccgaatcagcaggtcgtggattaccccagcttcaagctcgtcatcgttggcgacggtggaactggtaaaaccacatttgtgaaaaggcatcttactggcgagttcgagaagaaatatgagcccaccattggtgttgaagttcaccctctggattttagcactaactgtggcaaaattcgcttctattgctgggacactgctggacaagaaaagtttggaggcctcagggatggctactacattcatggtcaatgtgccatcattatgtttgatgtcacttcgaggctgacatacaagaatgttccaacatggcacagggacctgtgcagggtgtgtgagaacatccccattgttctctgtggtaacaaggttgatgtaaagaacaggcaagttaaagccaagcaagttacattccacaggaagaagaacttgcagtactatgagatctctgccaagagcaattacaactttgagaagcccttcctttacctcgcaaggaagctggcaggggatcagaaccttcactttgtcgaggctgttgctctgaagccaccagaagtgcagattgatatggccatgcagcagcagcacgaagctgagcttgcagctgccgctgcgcaacccctccctgatgacgatgatgacctgattgaatagatgttatcaatggcccttgttgatgcgatgggggggactttttataagaattcgtggtgcttcaatctgtgttaggctgtacctggatgttctcttgatgtatcctatgagttgagaatgatgttaatgacatctgtattctgtttttgatgatgggtttttgatgataatacagcgctattgtcaggc

SEQ ID NO: 317 - DNA, 1148 bp, Saccharum
gtaagcacgagaacgaaacacaatatagtggtgctgagaagctccagacttcaatcaccatgtaaagcatttgacggggcctgactttattagtagtacctacgcccggtattggatcacaggatcgagagggatcatgcatcggttgatgcctgggtcaccgtggcgtgtcggtggcaggtgtgttgctgtcgtgttcagccgcaaaactgcattgggaagagctcatctgttactgacagtgcggagcatccatggtggcaggttgccgctgtttgcttgtacaggagcaggagacggttcaggctcagattctcctggccctctaggttgacatgacccaatatttagagttggcatggaatctggaaccattggtggtgacagtgatggggagcttgttgatgctacattttgctgctcccggaggtgtgcgttcattaaagcattgtttttctccttctctgcctccatgagcttttgcaggacaccattttgatctgtaagtgctttctcctttttctgaagctcggaaattgaatcgaacatgagctgattctttcttgacctaatatgcttcaaagaactgtccaattgttgctccagttgctggagttcttttatggtcagtgaatccaattgttctcctaacagatgcctttgactcttctgaagtgcatcaagtttggattttaaccggacatattcatctccccaatctgcctggtcttcaatacttgggtcaagtactgctctttcttcaaatgagtaccgctggtaacgctcaagaatgccttccatgctggaatggctagagtactcgtagagcttccccttagtggagaagacgatgagcgcgacctctgcatcgcagagcacggagatctcgtgggccttcttcagcagcccgttccggcgcttggagaaggtcacctggcggttgatcttgttctcgatccggcgcagctgcaccggcccgcgccccatctccgccgcctcgacacctaccctctcccgctcactctcggcgcagcaatggcgatggggacgtgtgggaagaggaagacggggaaggatggatcaggtggctctcgtctctcgactcgagtggtgcgcaggcaagagagagctaggagaagaggaagagg

SEQ ID NO: 318 - DNA, 744 bp, Saccharum
gagatggcaactgaatgaacttagttcaagcatttctcaaacagtacagtagtctgctaattgcatggcacaatcaaccacccaatacaaggcttcaattctgaaacaaccatatgtaacggatagcataagcagaaactataactttttaatctattggccacccctcagagcaagcacaagatggagcactgaaccaccttcaatgttgtaatccttggcagttttgtcatcagcaagttgcttcccagcataaatgagcctctgctgaacaggtggaatgccttctttctcctcaacacgctccttgatcctatcgatcgtgtcagtgggctcgatgtcaatctcgatttccttcccagtcagtgtcttcaccttgatcatagttccacccctgagcctcaggaccaaatggagtgtcgactccttctgaatgttgtaatcagctaatgttctcccatcctccaattgcttaccagcaaaaatcagcctctgctggtcaggcggaatgccctccttgtcctggatcttggccttgacattgtcgatggtgtcgctgctctcgacctcgagcgtgatggtcttccccgtcagcgtcttgacgaagatctgcatctcgccggctatacgacccgcgatctggagctagggttttacggcggcttccctcgcgacgaagtcgccgcagcaaagcccgaaccgaacgaggctgttgcggtattgattgaagaatcaagccgatgg

SEQ ID NO: 319 - DNA, 566 bp, Saccharum
atcgtcgctcgcttcccgaccgcatcgcgatcagtcatctcctccctccctccctctcgccggagatcagacgcaccgccgccgccgggccgatggacgcctcctaccgccgcgccggcgccgggagcggctccgctccgcgctccgtcgacgacatctacaaggactaccgcgcccgccgctccgccatcctccgcgccctcacccacgacgtcgaggagttctacgcgctgtgcgatccagagaaggagaacctgtgcctgtacgggtacgcgaacgaagcgtgggaggtggcgctgccggcggaggaggtgcccacggagctgccggagccggcgctcgggatcaacttcgcgcgcgacgggatgaaccgccgcgactggctcgcgctcgtcgccgtccactccgactcgtggctcgtctctgtcgcattctactacgccgcgcggctcaaccgcaatgatcggaagcgtttgttcggcatgatgaatgatctgccaactgtttttgaagtcgtctccggccgtgtgaagcaatctaaggagagggacagatccagtactgac

SEQ ID NO: 320 - DNA, 987 bp, Saccharum
tagccctgtccaaactctctacatgaaggtgccttagttctgacaaagctttaaggtcatctaagtcacaaccctcaggagcattgttgtcatgaccgatgattagaccatccagatgattgagatgcttcaattcaccaacaccctttggtacatagcttagggaagttccctcgagacaaaggcatctaagctctagcaatgccctgagttccatcaagattgaggtaccttaaatgtaccaagttgccaatggatttcgggagggcctccactgctgtattgctcaaatctaatacacgcaagcatgaagctgactcaatgagaggatcaattgctctgacagttgggcttttgaagagcatcagtgaccttaagctcatctgctgcttcagtgaaatcggaccgtccaagctgttttcaatgttacacaatgtgagatgccggggctttgacaatgaggtgttcaatttctgctgactataaattaagatactctcatctgctatcaaaaggcgggctagtgagcggagaagatggtgtgttatccagcatcgctcaacactttctggatcaggctgtagtaggtttctgcttatcaattctacaaagtactcttcagctgattcttcgagcagtttgttgtatctggcatttacaattccttcagcaatccaacgccgcacaagatcaaagcgctgaatggggtattcttctggatacagagagcaatggaggaaacactccttcagctgagaaggcaggtcaacataactcacatacacagcttgtggtacttctggaaggaccgggctcatgaaccaagaatcatgattcagaaccatctcccattcagccttgctgttgcctcttgaccttaggacacctgcaatgaccttgattgctagaggatggccatcacatttctctgcgatcttaatcccaacatcctttaatgttgcaagctcttccaaattgcattggatc

SEQ ID NO: 321 - DNA, 1629 bp, Saccharum
ccgcctctggcccgtcggggcgtgcccgccgcagccgccgccgccgaggtccaaggtcgacacctccaccagcagcgccagcacgcacggcgcagagaagtcaacagaaaatggtagcaggaatcaaccggtcgcattggtagtctcaggttctacaactactagtaacgctgaaagcagttcatccgcatctaaagttggagaagagataaaagttgcctcccagctgcgcaagtttgcattcaatgatctaaaatgtgctacgcggaacttcaggcctgaaagtcttcttggagaagggggttttggatgtgtttttaaagggtggatcgaagagaacggaactgcacctgtgaaacctggtacaggtctcacagttgctgtcaagacactaaaccatgatgggcttcaagggcataaagaatgggtggctgaagttgattttcttggaaatcttcaccatcccaatttggtcaggttgattggatattgtgttgaagatgaccaaaggttgctggtgtatgaattcatgcctcgtggcagtttggataaccatctttttagaaggtctcttcctctcccatgggccatcagaatgaaggttgcactcggagcagcgaagggtctggctttccttcatgaagaagcagaaagaccagtcatttatcgtgattttaaaacatctaatatactgctggatgcggagtataatgcaaagctctctgattttgggcttgcgaaagacggacctgtaggtgataaaactcatgtctctactcgagtaatgggaacctatggatatgcagcaccagaatatgtcatgactggtcatctgacatcaaagagcgatgtctatagcttcggggtcgtgcttcttgagatgatgtcagggcgcaggtcaatggacaagaatcgccctaacggagagcacaacctcgtcgaatgggcacgccccctcctaggagagaggcagcgcttttacaagctaattgaccctcgcctggagggcaacttctcagtgaagggcgcccagaaggccgcccagctagcgcgcgcctgcctcagccgggaccccaaggcccggcccttgatgagccaggtggtggaggtcctcaagccgctgcagaacctcaaggacatggcgagtgcctcctacttctaccagacgatgcaagctgagcggatggcgcactcgaacagcatgaacgggaggagcagccacggcttcaagacgcagagcccgttcgggaggaacgggcagccgcccgtgaggagcctctccgacgggccccgtgcctcccctttccgctactcgccgaagccgaacatgaaatgagtgcagttggaggaggcgcatggctgagattttctgctggttgaaggcacggccccctggagtggtaggtgcggtggatgaagcctgggtttgttgggggtgactggttcggggcgtgcattgcattggggcggcgaaggcgaagtcgaaccgtaattgatgtgtgttgtagattgacatgtgcacaaaggaaaggatataggcgaaaaaggaggtgtaggtatcggagtttccttggcggatggatgtttgctctgaggttttaacttaatgaatgctgatggaccgttgct

SEQ ID NO: 322 - DNA, 668 bp, Saccharum
cggatgtgacgaaacgagagcacgcgcttggggctcaggatctcggaggcgcagagctggcggagcttgcgccagtagtcgccggagggggcgaagaggatgtcgacccactcgtagccgacgatctcgccggcgaggagcttgggccgtgtggcgaagttggggtcgtgcgtcttgagcacggcgcgcgccgtctccttagaggaggcgacgacgagcggcgtctggccgagctgcagcatcatgagcgggccgtggacgtccgccaggtctcgcagagcgcggtgcggcagcacgttcacgaggtggtgcatgctgccgatgatgggcagcttccgtggccctggcggcagccgtcgcctcggcttgagggccatcttcaccagctgcagcagtgccacagcaaggacggagaggaggagcgactggtagaagtactcgtccatggctaccgttattcctgcacgtcgttagctagtggtcacagagttcaagagcttacagaaactagctatagctagaccacgcgcgcagccgccagccggctttagacctccctagtgctttatatactagtcttgcttgcttggtgagttcattatctcgctgctccatctccatgtgggtggtggcggggtatatataacaccggcgagacgactgtaagg

SEQ ID NO: 323 - DNA, 513 bp, Saccharum
cgcgttgcgtcgtcgacctcgtagacggcgtcgttggcgtttgcggcgtacgtcgtcgctgggccccacgacgggtggtggtggtccagcgacgagaaggtcgtcgtggcggtggtgatggaggtggacgacgtgaagcccgtggtggccgacgacgaccagcaagacgacgacgaggcgtgcggagacgacttgggcttgccgacgacgccgcgcgcgtgggacttgagcgaggagatgagggagctgagcagcctcggcgcgcggcagttgcagccgacgtccaccaccacgggcgtctgctgccacggcaactcgaacctgctgccgccgccaccccgccgactccaaccaccacctgccagcgacatggtggcaactaggctaatgccttgctctgctagcgcctagcgcgcacgctcgcgatgccagcaagatcactcgatcagtcggtctcactctcgttggaactggcctcagcctcaggcctcgcttggcttggcgcgccttgct

SEQ ID NO: 324 - DNA, 477 bp, Saccharum
ctagaagctaggttgttcggaaacaaatattgtgggcactggctcggaaatagtgtgctggttgcaatttcttacaaggcattgtcagactagaagctagtctgacaatgccttgtaagatattgtaggaagtgtttttctgcccctgtccgagtgtaaattacgtaagttagctttctattgctgtatcctgtcatatgtattttttgaagttaagcccttttcggccccagaacataagttggtgtattagaggtctgtgtttgtgcagtccgttggtgtgtattagaggtctgtatttgagcagtccgttggtgtatcagaggtctgtatttgtgcagtccattctggcattgtgcgtgtatgtaaaacccgtagctcagtgaggttttgaaatcaagcaagctgcttgccttgattatgtttattgtaaaatctttgaagtataacttccatcaggtttcctatcctctcccc

SEQ ID NO: 325 - DNA, 692 bp, Saccharum
gtggtacgctccatgaactggtccagctcgggctccgtcgcagcgcccaggccgccgagcgccgtgcgctgccgcgcctccagctcttgcgccatcgccgtcagcctcgccgacacctccggtggtgcccccaccttcttgcactcgaggtaggcggcgaggagcgagtagtagtgcgggtgcgagatgatcttggccttgatggcctcgaggtcgcctgcgtagggagacgacgacgagggctcgcccttcgccttgacgttgacgcacgcgtcgaggaggctgccgccgttggcaagctgcagcaccgggttgccgctagcgccgctgttcccagtggccgccaccgtgttcagggtgagcggcaggcctgcgctcggcggttgctgcggcggcggcgcaacgacggcgctgagggaggatgcccacgggtggtggtgctggccgtggccgtggctgtggctgcttgcgccaactccaaagtggtgggtgatctcctccatcggagtgggcggatctccagtgaagtagtggtgcagcgatcgagctctccgcccactgtccccgcgagctcctgcgcaagcgcaaaaggggcgcctggaggtgagatgaagttcttggggcgagggaaagaggaaaagggctcggggaaggagagggaaaggaggatgcctcgaagtactatgccttct

SEQ ID NO: 326 - DNA, 648 bp, Saccharum
gctcccgtaggcgccaccgccaccatgggcaggcgtggaagacgacccgcctccgtaggcgccaccaccgccgccgggggtagacggagacccgccgtacgcgccaccgccgtgggacggggagccaccaccgtagctgccgccggtggacggggccgtcggagaggacccagagccgccgccgtgggacggggacccgccgtagccgccgccggtggagggcgatgtcggtgaggagccgaaaccgccgtgggacggggaaggcagcgtcgtcccgccgtgcgacggcgttggcacgtacccgccgccgtgggacggcgtcccggtggagcctccatgcgacggcgtcacgggcgtgatgccgccgccgccgatccccgggaacgagcgcgggtccatccccggcacgcagtccggcttcttcacgtcgtcgccttggcttgccttctccgcggggctggccctggactcgaccacggccaccaaggcctgcgcggccaacgcggcgagcacgaagctcgcgagcagagctctcgccgtcctccgcgcctccatagcagctcagctgctgccccccctgctcgctcgctcctcctctgctgctagctgcttcgatctgctactgtggagtggagtggtggtgtgctt

SEQ ID NO: 327 - DNA, 602 bp, Saccharum
tagattcttcccggaacttggcgtccatctccttgttgggcgcgtacttgggcaggctcgccggctcgcacgcgtacggcgccgtcgtgaagtactcggcgtcgagggcggcggcggcggtgccacgggcggtggggtcgagggagaggagcgtggcgaggaggcggaacgcgtggtcgggcatggacgcggcgaaggtgtcccggagccggctcgggtacggttgctgcgggcggaagacggcggcgtgggagatcccagagcggcgccagaagtcgtcgggcggcgagccgcagagcttgaagatcttgtggatctgctccacctcggtgcgtccctgcaggacgggccggcgcgcgtgcatctccgcgaagacgcagccggcactccagaggtcgacggacggctcgtacgccgtggcgcccaggagcagctccggcgggcggtaccagagcgtgaccacccggctggtgagcggcgccgccgacgccggggcgaacaggttcgccagccccaagtccgccaccttgagctcgccgccgttgctcaccagcaggttggcgcacttgatgtcccggtgcatcaccccgcgcgcgcgtccg

SEQ ID NO: 328 - DNA, 691 bp, Saccharum
agtgccgccacaggcagcctccgtcgtcgtgtatccccgtaatagctctgatccagataacctggccaagatcgtcgtggccaccaaccaccgcagcagcggcacgtctcaaggcaacacgcatagcgggagcagcagcctgactggtgatgtccacatgatcgaggccgggaattttgtgattgctgttcaggtcctccgtggcgccaccaggaactttgcccaggacaatgtgcttggccgtgggggctttggggtcgtttacaaaggggagctgcacgacggcaccatgattgcagtgaagaggatggaggctgtggcggtcaccaacaaggctttggatgagttccaggccgagattggcgtcctgaccaaagtccggcaccggaatctggggtctatactgggatacgcgatcgaagggaaggagaggttgtttggtctttaatacatgcccagtgcggtttgaggcaagcatctgttatcgtggaactcggcttgtgcgaggcctcatttaggtgaagaaaggcgcctagattcgcatgatgatgtcggatcggaggagggagtatacagggcacggctgggtttggccgcttagtgaagcaggattggctgtcggacgaacatgatctatgttaattgtcgtacctacgtgcgtcctgtagtggtgccttatgaaggggggggc

SEQ ID NO: 329 - DNA, 318 bp, Saccharum
caaaagacatgcattttttcaaagacagcagctttatgcacatgtgagttttattcctgatcaagtattttttgcaggtgttcattgaggccatctctgaattgcagcaagaggatcaaggtgctcatggtggctattttcattcatgactttctagtgacaaaagattttggtgtgtgggcaaaacatgagttgtgagctgtacaagccaacatcttagttgtgtaggtacttggtacttgagtgagctagctgagttattgcctcagtatttggtgtgaaaaaatggtacaagtacaaatgcttatggttctaacg

SEQ ID NO: 330 - DNA, 627 bp, Saccharum
cggacgcgtgggctgatactggttagcacaaccgtgatacaagatgcagatctttgtcaagacccttacgggtaagaccatcacccttgaggtggagtcttcggacaccatcgacaacgtcaaggccaagatccaggacaaggaaggcattccgcctgaccagcagcgcctgatcttcgccggcaagcagctcgaggacggccgtacgctttcggactacaacatccagaaggagtcgaccctgcacctcgtgcttcgtctgcgtggtggtgccaagaagaggaagaagaaggtgtacaacacccccaagcgcatcccccacaagcgcaagaaggtcaagatgtccatcctcaagtactacaaggtcgacggcgatggcaacatcaagcgccttcgtcgcgagtgcccctcgcccgagtgcggtgccggcatcttcatgagctggcacaagaaccgtcagtactgcggaaagtgcaagctcaccttcatgttcgaggagggcaccaagccccccaccgcctaaaaagcgcggggtcctgacggtactcgcacactcctcccccacccttaccctcaacaacaccatgttttccaggtcaacaacgactggatccttgatcgcacact

SEQ ID NO: 331 - DNA, 373 bp, Saccharum
cggaactcccggctcccgcctgctccatttaattactgactgactgatttccttccccgcattcgctttcttgtttcttccattcttccaccccatccgtaccagccgccgctgctcagggttccatgcccagcagtaccgtgtgatctgatccgcggcggcgcgcccattgcctccctccgcgaatggcccctccagccggggcagggacggaggggaggccggcgcggcggcgcggaaccggcaccggcacgggcaccagccccgggcgcaacaaggtgtgggtcgagccgccgggcaagagccaccaccagaccccggcgcggtcgccgcccccggcctcgtccccggccccggcggcggcggcggccaa

SEQ ID NO: 332 - DNA, 1687 bp, Saccharum
ggatggcgttgtggctcacgtcgatgtaggtcagctgctccggcagctccacggccgtgaggctgaaggcgaagccgttgcgggacaggtccaggtgctgcagcggcttccccttgccgaacacgcccgacgcgtcgccggtgaaggcgttgcgcgacaggtccaggtgcgcgaagctgacggcggcgaacccggcggggatggcgccggagaagttgttgtgcgacagccggaggtacgcctgctggtcggtgcacttgctgaggagcagcgacgggacgggtcctgagaggcggttgcggctgaggtcgatgctgcagaggctgggcaggtcggcgagcgacgccgggatgctgccctcgaaaaagttgaaggagaggtcgatcagggtgagctccgtgagctgggacaggaaggacggcaccgggccggagacgcccgtggaggagatggtgagctgggagaggttggacagcagcgcgagcgagtccgggatgttcccggagaggcccgggaggtggtgcaggaccagcgtgcggaggttggtgaggttggcgatggcgtccgggatggcgcccgtcaggttgccgtcgccgaagacggtgaggccgacgacgcggcccgtggtgctgtcgcagtccacgtcgtaccagtcgcagcagaaggtgtcgggtgtccacgacgcgaagtggtacgggctgcccagcgccgagttcaccgccagcagcgcctcctggtcctcctcgtggcactgcatctgcatcgacgacgacgacgagctggcggcgccgacgaggcacgacgccagaagcgcggccacgagtagcaggtgtgggaattgctgtgaggaggcggcggccatctcgtcgaagatcgatcacctcttacttgtgtcttgtgatcaactagctagctgcagtgagactgtgtgagagtgatgagatggtattgcttgtgttgtagtacctagactactcgatcgccggacgcgtgggcggacgcgtgggcggacgcgtgggcggacgcgtgggcaaaggggttgccctcatcggcggcggcgccaacagcacggtcgccggggccctccacttcttcgaggacccctccaccaggtacaccgaggtgaggggcaaggtcacgggcttgactcccggaaggcatggattccacatccacgtgtttggcgacactaccaacggctgcaactcaaccgggccccattttaaccctcacaataagccccatggagccccatttgatgaggaacgacatgtgggtgacctgggaaacataatagccaacgaagatggagttgcagaagtgttcataaggggacttacagatttcactgagtgggcctcattccatactgggaagggcagttgttgtccatgctgatcctgatgacctagggaggggtggccatgaactgagtaagtcaacaggaaatgcaggagctagaattggatgtggtatcattggaattcagtcttcagtttaacaaataacagcctagtaccaccacagaaaagggcaaaagtatatgcagtatgctggtgcagagacatggaaatgacgtttgttgttctggacccttattgtcttcagtcatgtatacaataatcctactctcaatgagaagaaattggtagtaagatcttgatagacttatattactggttatcca

SEQ ID NO: 333 - DNA, 840 bp, Saccharum
gaaactaacaatggttaactgagaaacacaagggaatgtacagttacatacatcacatacctccaaagaaaaaggctcaaaatacgcaaaacctttgttgtctgatcaataatagtgactttttcaagccaaccacactatatcgatcacgcacgttctagaacatgagatttacacaactataatcaccaccaggaaaagctgcctggtttccatcccatcagactatatatagatgagcagttgagtggacaatctacatatgaattccatctccagaaaaccctaaccgattaagtttggctgcacagaattttccacttcccagcctgttgtccatgcatccaaactcacaatgactgtgataattgactccagttcatcaaccggtgcgactgtggatgcctatccaaataactcctactagaaacgtcagcttcatcagcagcaaaagtttctgaatggcctgatgctgcaggaggtgaccaaactgggaccacagcgccctctctgccggtccagctacttgaagcctccgacactgatggagcaagtgcttctcgcctatgattctgaggttgctgaaagatgttgtgctggtgagtgccattgattctaggcgcagggccttcagtattttggatcatgtcttccctctcaactcggggatggaaatgtgcatgaaacggaacctgtgccctagtgtcctcactgttccctagatcggcggaaacctctgtttcagctcggttcaatgaagaggtcatggtaggcaccatctgatcctcacgcctccgagcaatcatcggcacattggctgttgcctgggctggctgccga

SEQ ID NO: 334 - DNA, 613 bp, Saccharum
agaggagtgcccctaacctttccttgctctccactgaaatctcctatctgcaaccatgcagttgctcaattctagcctcagctgaagcccaatcatccagtggtatataacttgctacaacctttgcaatttcccactccttcagccatcatcgatcattgaagaagcttcgtgctactggagaaggtgttcgccgtgcataattgtgggctatatacattccacaggcctgtaagctctgtgaattcggagctcccaggttctgcattgcattgagatggggaggcattcttgctgctacaagcaaaagttgagaaaggggctctggtcccctgaggaggatgagaaactcatgaatcacataacaaagcatggccatggctgctggagctctgttcccaaactcgctgggctccaaagatgtggaaagagttgtaggctcaggtggataaactatctgaggccagacctcaagagaggggcattctcccaagacgaagaagacctcatcattgagctgcacgctgtcctcggaaacaggtggtctcaaattgcagcacagctgccagggaggactgataatgagatcaagaatctatggaactcgtgcatc

SEQ ID NO: 335 - DNA, 522 bp, Saccharum
ctcaccactcctcacccctcacgccgccggggcagggccaagacccaagatccagggcacgcgccgtcccgctggcaacacgcctccccttgtcgtcgtcctcctcccgcgtgctgctgtggggggtgcagacggaagacccatccggacctgattgatttcttcgttctgttctgctggtttacatggcttcaagaaaggaaaggcctttgcttatttctggccaagcaaccagtgccagaataacaagatctcaggctgctgcaaatcgtacaagatctgggctggctccttatgtaccactacccctgaaaactgagcataaacatgcagcgaaaggaaagatgaaaagggaagcttcagatgaaaatgctgctgctgatgctggagcttcagctcctcagcctaaaaggcgcacagttctcaagaatgtaactaacataagctgtgctaaaacttccaaaaggtgcaatactgtgactgggctgaagttgggtccctcccagaaggttggacagagca

SEQ ID NO: 336 - DNA, 1500 bp, Saccharum
gccgcccccgcccgcgtcctctatctagcagtctctctgtcttcttcacctcctccctcccttgtctttgattgattgccgcctcctcttcctcttcgtctcgccactcccaccacaaggccaccgccaccatgggcaccacgtacaagtgctgcctcatcttcaagcgccgcttccacacccgcgacgcgccgccgcccgaggacgtccgcgccctcttctccctccacgccggcgggggcccccacatgggcgccgacggcctgcgacgctacctggacgcccaccaccaggaccaggagctggacgacgccgaggtggagcggctgctggagcagatccggctgcagcagcaacagcgcctcccgcgcctcgcccgcccgctcctcaccctcgacgacttccaccgctacctcttctcccacgacctcaacccgcccctccgccaccatgcgcaggcgcaccacgacatgacgcaaccgctctcccactacttcatctacaccgggcacaactcctacctcaccggcaaccagctcagcagcgactgcagcgacgtccccatcatcaaggcgctgcagagaggggtcagggtcatcgagctcgacatgtggccaaattcaacaaaggacgacatcaacatcctgcacggcaggacactgaccaccccagttccgctcatcaaatgcttgatatccatcaaagaatatgccttcgttgcatctccctatcctgtcatcataacgcttgaagaccaccttccccctgaactccaggaaaaagttgccaagatggttcttcaagtatttggtgacatactgtactacccgcctcactccggtcacctcaaagaattcccatcacctgaacaactcaagggccgtgtcctcctctcaacaaagccccccaaggaataccttgaagccaaggctgatgacaccatgaaagaggatgatgctgacctccgtcttggcaaaggggctaatgatgatgccgcatggggaaaagaagtaccggattttcagactgagatccagtctgcaaaaaagcacgatgatgatgccccaggacaccaaagagacgatgatgatgacgtcgatgatgaggaggaagaacagaaaatgcagccacatatagctccacagtataaacaccttatcacaatcagagcagggaagccaaaaggctctctagctgatgccttgaagagtgatccagaaaaagttaggcgtctcagtttgagcgagcaacaacttgccaaagtggcagaggaacatgccacagaaattgtgaggttcacgcagaggaacatactgaggatatacccgaagggcactcgagtcacttcatctaactacaacccgtttattggttgggtgcatggtgctcaaatggtggcattcaatatgcagggatatggaagagcgctttggctaatgcacggattttataaagcgaacggtgggtgcggttatgtgaagaagccagatttcttgatgc

SEQ ID NO: 337 - DNA, 564 bp, Saccharum
gggtatgggtcgggtgaaggatatggagcaggtggtgctcatggaggaggctatggaagcggtggtggcggtggaggtggcggtggtcaaggtggtggttctggctatggatctggatcaggctctggttatgggggtgatcttcagcaacattcttctgatcaggtgggcatccaatacatgcgcacacttcccaactgtggggaggactgtgtttggcgagcatcactcgttgttagttttggtgtctggtgcatccgccgagtgctggacatgtctctagtggaaagcagaccagaactttggggcaagtatacctatgtccttaaccgtcttcagggaatcttggaccctgcattctccaagcctcggagtgctctgaccatatgtgcttgtcttcagaaagacatcagagctctcaatagtccaccccacagtgggctaacagccatgggtcccatccccataccaatccgtggcaccttcacaactgcaggtgtggttctggagatgatcaaggatgtggagaccgcagtctcaggccgcaagggcaggagtggcaca

SEQ ID NO: 338 - DNA, 1094 bp, Saccharum
  misc_feature 736: n = A,T,C or G
tgtcagtttttactcgtttgctttcttattgcagagaacattatcgataaaaaagatactaggtgttcgggccaggtttccttcgaatccgttggaccttcaagaaggcccatagctacgaaatggaatgtagcagcccacggtgccactcttcccggttttgcttccctccaggctccagcttcccatctccaatcaagaacactgaacacaccacacacgaacggagatacgatcatccatacacatacatttgagagtttgactcttgagcacgcaagacgcaaggcagcatgtgacgttcactgctgccaccggcgagcagctagctagctcttcccggcgccggcagcctccgtggacttgtcatggagcacgctggcggtctcggacccggagctgtgcctctgctccgccgaccaagacacaggcgacccgaccttccagtacttgccgtcgccccacttcccaccacggctgccgtggccaccaccgtgcgccgactcttcgccgtcggagttcgatatcgacacggcccgccagttgctccacaccctcagcatggtgtaaagcagcgccacgcacaccaccgccgagaccagcgcgatgcccgcaacgatcacgaccacctccgtgcccgacagccgcctagcaggcgacggtggcccgcacggtgtcagcggcgcgccacagagctcgttgccgacgaacgacgccgccgggaagctcgacagcnccgcaggcaccgcgccggagaggaggttgtcgggagaggttaaggcggtgcaggctcgtcagctgcaccagcgaggacggtatctgcccgtccagccggttggacgacaggttcagccgctccagcttcaccaggctgccgagggacgccgggatctcgccggagagcctgttccggctcaggtccagtatcacctgcagctccgtgagctgcccgagctccggcgggatcggcccctccagcgagttctccgacagccttagctcgtacagcttgttgcattgctgcagcgacggcggtatggcgccggtgaggctgttcttgttcaggttcagaacgttcagagacgtcagccttc

SEQ ID NO: 339 - DNA, 591 bp, Saccharum
cgttcgacggtagtattcgagccaacatgcagattttcgtcaagaccctcacgggcaagactatcacccttgaggtggagtcgtccgacaccatcgacaacgtcaaggccaagatccaggacaaggagggtattcccccggaccagcagcgcctgatcttcgccggcaagcagctcgaggatggccgaaccctctcggactacaacatccagaaggagtccaccctccacctcgttctccgtctgcgaggtggtatggccaagaagcgcaaaaagaagaactacaccacgcccaagaagatcaagcacaagaggaaaaaggtcaagatggccatcctcaagtactacaaggtcggatccgacggcaagatccagcgtctgcgccgagagtgccccgcgcccacctgcggcgccggcgtcttcatggcctggcacaaggacaggcagtcgtgcggcaagtgcggtctcacctacaccttcgagcccggaaccaagcccaccgcggcctaagctcttcgcccaccccctctctgagctaggatgcatgtagatcgcgcggatcgaacgatcttcgtgtaatataatgcatctg

SEQ ID NO: 340 - DNA, 801 bp, Saccharum
cagcaaagcatccagcattccagctagcagctagtactagaatctatatatcgtacacaagtagtggaggcgcatctatctgcggcagtccctttcttcttcctctcaattgatacttgataggtgcatcgaagcttgtttcgttgggtggcctttgtctctgtctgccggccagcagccaagctattgagtccatccagcgccaagcagctcacacatcggtcgacgacggggacaaatcggagggcggagcgaggagaaggacaccatcaacgcctgcccgctgccgaccgatggacgatcatcctcatcatcagtcgatggcgacaccggcagcagcaagcatgtgcggcagcaagagcaagacgaagctgcagggtggtggtgagcgtagtagtaggggcagcggcggcggcaacagtccgacggcggcgatgaggaagggcccgtggacggaggaggaagacgcccagctggtatggttcgtccgcttgtttggtgaacggcggtgggatttcttagcaaaggtctcaggtttgcgcggtggcgggtgcatccctaagcatgcatatatacatatacacatatatgtatatagatgcatgcttggggattgatgtagaatgggctatggcgatgggtgttaattaaccagttctttccttgtttctctcctccttcttctctgtgcatgcgcatgtgtcggcgtacttatgcaggtctgaggcgcaccggcaagagctgccgcctgcggtgggtcaactacctccacccggggctccggcgcggccgctctagagg

SEQ ID NO: 341 - DNA, 604 bp, Saccharum
tgagaggcatcagctcaggggtctcatcagtcgcatacccaaacatgtgtccctggtcaccagctccaatctcctcggggcgcttggtgaagtggccatgcacaccctgagcaatatcaggagactgctgctcaatgttcacgagcaccttgcagtggtcagcgtcaagcccgacatcggctgacacgaaaccaatgttgcggcaggtctccctgacaatcttctcgtagtcgacattggccttggtggtgatctcaccaaagaccatgaccatgttggtcttggtgcaggtctcgcaagcgaccttgctgtcagggtcctcagcaaggcaagcatcaagaacagcatctgagacctggtcgcagagcttgtcagggtgtccctcgttcacagactccgaggtgaagaggaaggtgtcaactgcggccatcttctctgatctgctgctgcggcggcgcggggtggtcgggcggatccgagtccgacgagatccggtggaggcgccggacggggtgggtggagtgggatgagatggtaacaagtcccggttggggaggggggctcgtctcgtctcagatccgacccggccgcccggacgcgtggg

SEQ ID NO: 342 - DNA, 476 bp, Saccharum
ccattttctgcgctcctgctctgcctcgcagctcgcctcgtcctcatctcgtcttccccgcgcccgcgcctccgcttctcctcgtacggagcaagctaagcgaaacagcaagccaccaaagagaagcccagcacagcagcgcacgcagtcttgttgccgctgaaagctgtgcttcacccccgcattcctctatggggcggcacaagttccggctgtcagacatgatccccaacgcgtggttcttcaagctccgggacatgcgcgcgcggggcgccgctgcggtcagcccccgcgtggccacgttgcgcccgcccccgagcacgccgaggcaggccgcgccgtggctcccgcaccgggcgtcccactactacacgccacgggccggggacctcgtccagctgggctcgccgtcgccgctgcaccccagggcctccgacacgcgctttccgccgctgcagctgtcgtcgccgcgccgg

SEQ ID NO: 343 - DNA, 1047 bp, Saccharum
tcccaggccgcgcgcgcgtgtctgagctgtcgctgatggatggatgatagataaagccgtggagcagggtgaaggggaggtgctgcccatggtgaccatcgccatggccgtgtagaggagcgccgcagccggaagagatttttccgatacagacagagatataaggggtgggaaggaaggaagagataaagggaagtgagcaggatgaattcaagaactgcgacagtggcggccggcctcctcctcctcgtcgcgcttgtggcggtggcggaagccgacaccgacgccggcgatgttgcggccttggggaatctctacagctcctggaacagcccggcgcagctcaccgggtggtccgccagcggcggcgacccctgcggcgccgcgtggacgggtgtctcctgctcgggctccgccgtcacctcaatcaaactttctggtatggagctgaatggtactcttggttatcaattgtcaagtctacaggcactgaaaacaatggacttaagcaacaactacttgcatgatgcaattccttaccagttgccatcaaacctcacctatctgaatctggcgaaaaataacttctcgggtaatcttccgtactctatatccaacttggtttcacttgagtacctcaatctcagccacaactcgttatttcaggaaattggtgaactatttggaagcctcagttcactttcagaactagacttatcttacaacaacctgacggggaatcttccattttctatgggctctctgtcaaaactttctagcctttatatgcaaaataatcaactatcaggcacagttgatgtcctcagcaacataagccttgcaacactaaatattgcaaacaacaatttcagcggcatgatacctcaaggattcagctcaattccaaatttaatagttggtggaaactcatttgttaatatgcctgcctccccgccaccaactctgaagccacatgatcagccaaacgatcctgaaggacctattagtgctccaactatcccagacactcctattgatcaagacgac

SEQ ID NO: 344 - DNA, 690 bp, Saccharum
gcacgtcctggaggtcgacggcgccgccactggcctcggcgtcggcgagcacggggagcagccgccggtgcacgagctcgacgagcgagctggccgtgagcgcgcggaactcggcggagtggaactcgaggctggccgccttgcgctgccgcctccacacctcgtcgtcggcgccaaagatgccgtcaccgaggaggtcccgcacggtgtcgcggaagtaggggcccttggggaagctcccgaaccgggtcttgaggaggtgctccaggttccgcgggtcggcggtgaccacgcactggaggttggtgaaccacggcccgcggaacgtgaacgtgccgccgcgcgccttgagcacgcccgtgatccactcgtacatgtcgctgcggaggcccaggagcagggacgggagcatgcccacgagcggccacgtcggcagcccctgagtgcgccgctgccgcagcgagtggatggccacgaagatggacgcggccaccagcacctccaccgtctgcacctccgggagcaggcccgccagtccgccgctgccggcaccggccgccgccgcagcaacagtggcgttttgcgagacggcggtgtccatggcgctcatggatggtgtgttggcgtaggctgggcaaagaaaggtggtggtggtggcttggccttggcttgtgtgtgcgctcggacgcg

SEQ ID NO: 345 - DNA, 528 bp, Saccharum
atggcttatcgtggaagcagtctttctggtaaactttgatttggaagacgaaacattcttgccaccaccactatcatcatcatcccacgcatcgtcatcgatcttccttttcctcctgtcaagcccagacacagccctcttcataccaacccggggcactccctcactccgtctcctcgtcgatcccgcgcttacttggcgccctttgtcttctttcttcttgtcgcccttattccaaccagcaaccctggttccttttgctttgtcatctcctctttccttgttcttccttccagtggcagtcccaccactgctccagttcctcttgccaccagaggcaggcttagcttgtgtcatgggggttcagttcaacaccacaatttcttggaaaatgtactgcgctagcacctagggcaggggggctggtggggtgcttgttgccggcgaagagaggaacctggcgttggcggcggcggcggcggcggcgagagagagagagcgcacgcggggtgaacgcggacgcgtggg

SEQ ID NO: 346 - DNA, 601 bp, Saccharum
tgtcatcggctttgatgatactcatcaggtcattcaggtagcctttcctgggctggcaggccacgacgatatcacgatggccgtgctccagggcctcctttagacccatgaacgcgccactcatcataggatgcttgtcaccctccacgatgtaggtcgtccggttcagctgctgcatcaggcacttggcgatttcagatactctcaagatgagctggcgcaacctgcggcagtcatcttcgttgtggcgaaacgtctccacaagtaccgtgatcttcatccccaagccacagatggtctggaggatgcttagcagatcaaccatgtctacgacgctcgcgtgcggcctagctctcctctggacaagtgcagtggtctcttgtagctaatcaatcgatggatcgatctcctccgatccctcccctccaagctatcgagaatggcgatggcagaagctgtgtgctctcgcttcacttccttcctcaattttctatgttttctgttaaaaaaagggagtgggtgggtggggtgggtggggccggacggaggagagtgcgtggaaggaagcggagcagcttgcttgcagatattttcttctctc

SEQ ID NO: 347 - DNA, 1870 bp, Saccharum
cgctgctgcctcggccctcggcgctgcgcccggccccggcaccttcctccccacttcgccgccggcgggtggagtcgggccggagcagccgctctcctctgttaccccccccaaaaagaaaaaagaaaaaaagagtaccaagcaagcgagccgccggcagctcaggcagcagccatggggcacggcgtcagctgcgcccgcaccggcgacgagcacgactacttccgcgcggcgcaggtcggggacctcgacgccctgggcgcgctcctcgccgccgacccctccctcgcccgccgcgccacgctctacgaccgcctctccgcgctccacatagccgccgcgaatggccgcctcgaggtgctgtccatgatcttggatcacggggtgccgccggacgcggtgaatcggcacaagcagactccgctgatgctcgcggcgatgcacggcaagatcgactgcgtgctcaagctcctgcaggccggcgccaatatcctgatgttcgactccctgcacgggcggtcctgcctgcaccacgcgtcctacttcggccacgtcgactgcctgcaggccatcctcacggcggcgcggaccacgccggtggccgactcatggggtttcgcccggttcgtcaacgtcagggacgaccacggcgccacgccgctgcacctcgccgccaggcagggccgccccggctgcgtgcaggtgctgctggagaacggcgccattgtctccgccctcaccggctcctacgggttccccggcagcacgtcgctccatctggccgctcgcagcgggaacctggactgcatccggaagctgctcgcctggggtgcagatcgtctccagagggactcagcagggaggattccttatgccgttgcgctgaagcgcagccacgaggcgtgtgcggcgctgctgaacccttcgtcagctgagcccatggtgtggccttccccactgaagttcatcagcgagctggacccggaggcgaaggcgctcctggaagcggccctgatggaagccaacagggagagggagaagaagattctgaagggcacaaagtactctccaccatcgccttccccttgcgagcatgagaatgatgccgatgccatcgacgatgcgtcctcggaggcgagtgacacggagctatgctgcatctgcttcgaccaggcgtgcacgatcgaggtgcaagactgcgggcaccagatgtgcgcgccatgcacgctggcgctgtgctgccacagcaagcccaacccgacgacgcttacactaccgtcgccggcgtgcccgttctgccgcggcagcatctcgcggttgctggtggcccgagcaagcaccgcgttcagcgacgacgccgacaaggctgcttctgcggcggcctcctcaccgcagctcgtccggcggcggtcccggcggtctcacaacctcagtgacggcgggagcagcagcttcaaggggctgtcgtccgccgtggcagggtccttctccaagatcgggcgcgggtcgagccggatggccgatagcgacggcatggacaagcccgagcacgacctgtgatcagcattggatcctgtgcaagtggagcagagtgccggctgatcggccggcccggacggctggcttgtggtactgaagctgaagcagccattgccactggctttccaagatgaggacatccaaggctccaagcaagcgtgatcgtgggttttatatagatatatactaggagctactagtactactactaaaataagtactagtgtaatgcatttctcttcttctccctatgtccctgcctgtctgtcttgtcctatttttgggcatgccattgcaaggattcacctggccattgccgtattccattgtc

SEQ ID NO: 348 - DNA, 1173 bp, Saccharum
cagctcccaccctctcgcccgccaggagaagccgccgccgctgctgccgcgtccacaggcaccgcaggggaccgagatgggtggttttgtcaagacgctgaagaccaatgcgtacttcaagcgtttccaagtgaagttcaagagaaggcgtgctggtaagacagactacagggccagaataaggctgattaaccaggataagaacaagtacaatacacccaaatacagatttgttgtgagatttaccaacaaggacatcgcagcacaaatcatctctgctagtatagcgggtgatatggttcttgcttctgcctactcgcatgagttgccacgatatggtcttgaagttggtctgaccaactatgcagctgcctactgtactggccttctgttggctcgtcgtgtgctcaagatccgtggtttggatcaggagtatgagggcaatgttgaggccactggcgaggacttctctgttgagcctgctgatgagaggaggcctttccgtgctctcttggatgttggccttatcaggactacaacagggaaccgtgtctttggtgccctcaagggagctttggatggtggcctggatattcctcacagtgagaagcgatttgctggtttcaagaaggatgacaagcagctggatgctgatatccaccgcaagtacatctatggtggccatgttgctgactacatgaagaaccttgctgaagaggagccagagaagtaccaggctcacttcagtgagtacattaagaagggaattgaggctgaggacatggaagctctgtacaagaaggtccatgctgcgatccgtgcggatccttccgtggtcaagtcaaccaagcagccaccaaaggagcacaagaggtacaaccccaagaagctgacatatgagcagaggaaggccagcctcgttgaaaggctcaaccaactcaactccggtgctgccgatgacgacgatgaggatgacgagtaaagtttagtccccatcgaagtagtgctatcttatgaggcgatcagtacttgtgctatggcatttatccttacctgtagtcctgcaacaggcatttttgtttaagtttggtgatgtgaacaaagctgtttctgttagtttcgagctggagttctggatatttactcttgatattaaaatgctgccgtttggac

SEQ ID NO: 349 - DNA, 1732 bp, Saccharum
  misc_feature 1715, 1716: n = A,T,C or G
cctcttcctcgccggcggcggtcggagcctccgcctctgagccgttcctctctctcagccccttcctttcctagcaaatagtccctttctcttagctaaccccccgaccccgacgagttctcaccccgagagtaaccgacccaccgacccaccggcatggagatgaagctcaccatcaagagggtgcccaccgtcgtctccaactaccaggacgacgccgacaagccgcgcgccggctgcgggaggaactgcctcggcgactgctgcctgcctgcttccaagcttcccctctacgcgttcaagttgaatccggcaaagcgctcgcaggaggatgctgcttcaaccaagctgcttgttgatatcctccttagtgagtgggaggacaggatggcccgaggcttattccgctacgatgtcactgcctgtgagaccaaggtcatccctggcaaccttgggtttgttgcacaactcaatgaagggcgccaccttaagaagcgccctactgagtttcgtgtggaccgtgtgctccagccatttgaccctgccaagttcaatttcaccaaagttggccaggaagaggttcttttccaatttgagaatggtgatggtgatgacagctatttcctgaatgacgctccaatcattgctgttgatcgtgctccaaatgttgttgctatcaatgtgagcccaattgaatatggacatgtgcttctcattcctcgtgttctggaccgcctgcctcagaagattgatccagagagtttcttgcttgcactgcaaatggcagctgaggcagctagcccatacttcaggcttggttacaatagcttgggtgcctttgccaccatcaatcacctccactttcaggcatactacttgtcagtgcctttccctgttgaaaaggcagctacccacaagatccctctttctgaggacacaatgaagaatggagtgaccgtgtccaagctgataaattatcctgtgagaggcctggtatttgagggagggaacacactggacgacctggcaaatgtggtttccaatgcttgcatttggctgcaagacaacaatgtgccttacaatgtgctcatttctgactgtggcaagagggtcttcctgttcccccagtgttatgcagagaagcaggctctgggtgaagtgagccaggagctgctggacactcaggtgaacccagctgtgtgggagatcagtggccacatcgtgctgaagcggaggaacgactatgaggaggcatctgaaacctccgcgtggaagctccttgctgaggtctccctctctgaggagcgcttcgaggaagtgaaggcgtacatcttcagtgctgctggcctggttcagtctgacgaggaagaggaggaagccagcgagggcaagggcaccaccacctatgctcctgtcccggttacccctctacctgtcgctgaaggctgcctcgtccgccagtgagtccgtggactggctattgtgtgttcctggtcacctataactgtgcggtaataaagctctgttggtactgtatatgcttgcgagcgctgtgctctgctgctactttgctctcgtttgtgtcctgctgctctcgtggtgaactcggtaattcagtgctctgcaatattaagcagaggctattgtattgtttgggtcgtttgttaattattactagaactaaatgaaatgtgataaacattactagtaaaaannaaaaaaaaaaaaaaaa

SEQ ID NO: 350 - DNA, 414 bp, Saccharum
aacccacccacctcccaccctcgccaccgtgtggtccgtccgcgaccccccatcctccactaaccgaaccaggaagcaccaagcaaagcagcagagctcgctcgcgctgggatcgtccaccaacaacaaccgtatcggtccttgcttcctctacctctgaacgagaacgcgaacgcgaacgccgcgccctgtgataactactaccccagcatgtgctcaggacctcgcaagccgtccacccctcctctgcctgcagcgacggcgacggccaaggactcctcagtgatgacggcggcggcggcggtcctgctggagctggcggcggcggacgacgtggtggcgttcaggcgcgccgcggaggacgacaaagccccggccttggacgccgcgggccactggtacggcccgtccgcc

SEQ ID NO: 351 - DNA, 920 bp, Saccharum
cccacgcgtccgcggacgcgtgggagatctaagttagtcgcgggcagcagccatgagcgaggtgttcgagggctacgagcggcagtactgcaagtgcaccgctgcctccgccctcgatggagagaagaagaagcagaagctgtccgagatccaatccggcatcgaggaagctgaatcgctgattcggaagatggacctggaggcaaggagcctacagcctagcattaaggctggtttgcttgcaaagctgagggagtataaatctgacctcaacaacgtcaagagcgagcttaagaggatatcagcgcccaatgccaggcaggctacccgggaggagctcctggagtctggaatggctgatactctcgcggtgtctactgatcagaggggaagattgatgatgacaactgaaagactgaatcagtccactgacagaatcaaagagagccgaagaactatgttggagacagaagaacttggtgtgtcaattcttcaggaccttcaccaacagcgacagtcactactacatgctcatactactttgcacggagttgatgataacattggcaagagcaagaagatcctggctgcaatgtcaaagaggatggataggaacaagtggatcattgggggaattatcacggctctcgtcctggccatccttctcatactctacttcaagctcgctcattaagcctgcctgcaggtaaggttccccccacatatctatgttcagtaattgtgtgataagagttgtctgaatgctgtgtattgagcaacacgtggctcgccgagcatcatttgttcccctaaacctgtaaacttccatggctcatgctgtgtacagtcaagatacttccaactatgtaaactgtcgaaagagtgaaaaaaatttacttggtgttgagtctcatgtgcct

SEQ ID NO: 352 - DNA, 443 bp, Saccharum
cggtggcacccgaggccaccgtggacgacgactgctgcggcgaggagggcagcggcggccggcgcaagaggggcagcgccggcaccaggcacccgacgttccgcggcgtgcgcatgcgcgtctggggcaagtgggtgtccgagatcagggagccccgcaagaagtcgcgcatctggctcggcacgttcccgaccgcggagatggccgcgcgcgcccacgacgtggccgcgctagccatcaaggggcgcgccgcgcacctcaacttcccgcacctcgcgcacgagctcccccgcccggcgtccacctcgcccgccgacatccaggccgcggcagccaaggctgctgctgctgccgccgccgccgtcgccgtcgatgccgatgccgacgtagagcaatgcgagtcgtgctcccatcattttgccgagacgccatcgtcgtcgtca

SEQ ID NO: 353 - DNA, 1045 bp, Saccharum
atggttgtgttgctggtactgaatgacggcggcgatcttgctgggcggctggttcgtgctcttgtccaccaccacatgcccatcggctgacgattgcttattgtcaagggaatgcctcggcggcaagccgccaccggccccgccgaatatgttgttcttggggctcatcacgccgttcatggcgtgtctcctgtcatctttgggattggggctcttattcaccttgctgaggtacgcctcgccgtccatggcctggctgatgaagaacatggacttgcagtgctccgcggcggacgcggacaggcgaggcgatcgtccgttggtgctgttgtgcacgaggaggcatccggcggctgctgcatggcgccgctgttgcctcctcctcgtgctcctgctccctgcttcatcctctggatctggtcctccagcctggcgatctcatcctccaccagcagcagctccgcgagcagctccttggccttggtggggatgaaggcggggatgttggtgagggccatgaaggatcgaacagagctgggctgcagggcgcgctccaggatctggtgcaccgtctcctcgttggacagctgctgcttcagctccgacacctcctgttcaagcgcttcacgccgctgccgttgcatcatcgcgctgccccgcgtcctctgcgacacaggaggaggacggtgatcgccgatggagtgaagctgatgagccgcctgaggctgatgaggaacaggcggcacggcggcggtggcattgtaagtgtggtgggtatggcctgctgcttgcatccgcgcgaccacgtagtccatcgccggcggcctgtcgatcgccgatcgcgggctacgctagcttttgtttcctcgcggtggccggcggtgatcagatcattggggatcgatcgatcggccggatagatttgctggtatctgctactgcctattactgctaggggtagcatgcatatcgctcagtactatacatatatagcaagctagagctgagggagggacctgatcatcagagaattaataatacgaat

SEQ ID NO: 354 - DNA, 1293 bp, Saccharum
attgtgccacatcccgctggatgtacgaacgaaccaatagtaatgacctgattgagtgttccaacctgtatggactaggacaccataaaggctgtatttaaaatctgtacctttagagtcactaacaaatggtttcaaatcgagacttggttggaagtccacttttttgtcaatcttttcacgaggattgaaagggctgaagcgcttcagatggattgtcaagacattgggagccttatcaattgtaaaccgtttctttgctacaactttctgcctgcagcgttcgcactggtattgcttttgacccccgtctagtagctcatcctcagtaaaattttctagtgcccgcactaaagtcgtggccttggcaatatcaagactgaggtccaagaaaggatcaaatttattggagcaatgtgagcaacgcatgcatttgacctgacttctaaggcggccaccaaatattttgtgaactaagcttttgtcataagcactttgagactcactcggtaccccagaaggtaaacagcatttatgcatggattcaagcaaattaaccattaactcatgtgcatcttcttgtcttgaattgcggaaagtgcgagaaatgcagcgcaagttcttgacaatacgaaatggtgtcactatttttccagttgattctagagcagtcttgacatgattctgaagagcacataatgcacaaaatccagatgtgcgacatgaggacttgtgcttcccgctctgtaaataggctgcgaacggctctgtgtacgtcaagcattgcagaactgagttgaggtagcaggtattcccaagattttccaaaccagcaccaattctcccgaggtagatccttgcgacgctgagctccggatcgatcccgccggcgtccgccttctccggcctcctcgcctccccctcgctgctcccaaccgccgccccggcccccgccttaccagcggcgtcagggttcagcgtctccgtacggaacccgcctccccccaccgccacagaggcatgcggcctccgcgcgaggtggaactcaatccgccggtgcagcaccccttcaggcgccgccgccgtcgaaacctccgccattcctagggtttctcaccacagcgggagcagcgcagagccacgagaccgggcaggcaggcgattagcacttcactgaatttctggtggaattctgtcggattaaacctagcagggtcgatcgataaggaaggggaaattggtgcggcgcgctgtttttttttccccttttttctggccgccgttcgcgacgcg

SEQ ID NO: 355 - DNA, 972 bp, Saccharum
tttatcaaagcacttatgatttgtcgacacactaccaaaatcgcatagtttccatgccccatcagcagcaagaagaacattttctgcctttaggtccctgtgagcaagaggtggcgtctggcaatgcattgcaaagatagcattgcaaacatcccggaagatgagcgccaccttctcctcatcaaagtagcccgctcctctgccctccaacacagaaaccagagacttctcgcagaactccatgagcagcagcgcctccctcgtgcgccccatgtccagtatggcgtgtgcaaccagcgtgaccacatttgggtgtcccttgagtgaccgcatcaccgtgatctccttccggaccaggtccagcgactcctcatcctggacgatcacgtgcttgagggcgtactgcttcgccgggttgaccaagtctcgggcggcatagacggatgagaacccaccctcggcaatggcctcccggatgtgcaccttgacattgccgacatcgacggtccgaccctccaggccactgggctgctccttggggatgaactgcttgagcctccacatggctgttgttgcgcaaaaatcctagagaaaccttgcagcaccagactggccgttaggcacggattgtgggtttagctgaaccccagaatttgttgcccaacaaacggagatatcgatccaggtccggccgggtggatctgagacaccggtaccagcagagggcagcaccgacaccttccgcagaaagagaggaaagggaacttgggtggtggaaagaggggcctcggtttgtcgtgcccgtcgccagccggcggtgaggccgccgccaacgaggcgcagcgaggggcggcggcagagggagcaggaacgggaaccctctgacgacgaggcgcagctggcagcggcggcggcggcagcgggataagaaagcaaccctctgtatctgatcttctggtgctttctggcttg

SEQ ID NO: 356 - DNA, 2742 bp, Saccharum
tcggcggcccctgaacccgaacgaacacccgcaaatatctgtcgccgtctcgcgaacagcaccaaccgcccgccttgaattcgaccgccatggcgagccagggcgagtcgtcttcctccgatccgaaggggaagaaggattactcgacggcgatcctcgagaggaagaagtcgccgaaccggctggtggtcgacgaggccaccaatgatgacaactccgtcgtcgctctgcacccggacaccatggagaggctccagctcttccgcggtgacactgtcctgctcaagggtaagaagagaaaggacactatctgcattgtgcttgcagatgacacgtgtgaggaaccaaaggtccggatgaacaaggttgtcaggaagaacttgagggttcggcttggtgatgtggtatctgttcatcaatgcccagatgtcaaatacgggaagcgtgtgcacacacttccaattgatgacaccattgaaggcatcactggcaacttatttgatgtctttctgaaaccatacttccttgaagcctatcgtcctttgaggaaaggagacctttttctagtcaggggtggcatgagaagtgtagaattcaaagtcatagagactgatcctccagagtattgtattgttgcaccagatacagaaatattctgtgagggtgagcctgttaagagggaggatgaagaaagacttgatgaggttggctatgatgatgttggtggagttagaaagcagatggcccaaattagagaactggttgaacttccactgcgtcatccccagcttttcaagtctattggtatgaagccaccaaagggcatattgctgtttgggcctcctggatctggcaagacccttattgctagagctgtagctaatgagacaggtgctttcttctttttgatcaacggaccagaaatcatgtcaaagctagcaggagaaagtgaaagcaatctcagaaaggcatttgaagaagctgaaaaaaatgcaccttccatcatttttattgatgagatagattccatagctcctaagagagagaagacccatggagaagttgaaaggcgtatagtttcacagctcttgactcttatggatggtctcaagtctcgtgcacatgttattgtcatgggtgccacaaaccgtccaaacagtatcgatcctgctcttagaaggtttggtaggtttgatcgtgagattgatattggtgttccagatgaagttggacgccttgaggttctccggattcacaccaaaaacatgaaactggctgaaaatgttgacttggagctcattgcaaaggatacccatggttatgttggtgctgatcttgctgccctttgtaccgaagctgctcttcaatgcatccgtgagaagatggatattatagatcttgaggatgagaccatagatgctgagatattgaactctatggctgtcacaaatgaccatttcaagactgcacttgggacaagcaacccatctgctctgcgtgaaactgttgttgaagttccaaatgtctcttgggaagatattggtggtctggaaaacgttaagagggagctacaggagactgttcaatatcctgtggagcatcctgagaaatttgaaaagtttggcatgtccccttcaaagggtgttttgttttatggccctcctggctgtggcaagactttgttggccaaggcaattgctaatgaatgtcaggctaacttcattagtgtgaagggtcctgaacttcttaccatgtggtttggtgagagcgaggccaatgtccgtgagatttttgataaggctaggcagtctgctccatgtgtcctcttcttcgatgagcttgactccattgctactcagagaggaagcagtgttggtgacgcaggcggcgctgctgatagggtgttgaaccagctgcttactgagatggatggcatgaatgccaagaagactgttttcatcatcggtgcgactaacagaccagatatcattgaccctgccctgctgaggccagggcgtcttgatcagctaatctacattcctctacccgatgaacaatccaggcttcagatcttcaaagcctgcctcaggaagtctcctgtggctaaggatgttgacttgaatgctcttgccaaatacacccagggtttcagcggtgcagatatcactgagatctgccagcgtgcgtgcaagtatgctatcagggagaacatcgagaaggatatcgagagggagaggcgcaggaaggacaaccctgaggccatggaggaagacgaggttgatgacattgctgagatcaaggctgcgcacttcgaggagtccatgaagttcgcccgccgcagtgttagtgacgctgacatccgcaagtaccaggcctttgcccagacactgcagcagtcccgcgggtttggcagcgagttccgcttccccgaccaaccgacggcagctgcaggctctgctggtgcggctgatcccttcgcatccgctgcaggagcagctgacgatgatgacttgtacaattagattagcagtcatgttgtgacgcttcttgagtactttccttcgttatatatgcttattattatatgttaatgttatacttatgtttaatacacggggagtggctgtacctatgcagttaagttaatattttagtaggtccttgaatcgtgcccattgcatgcttgcctggtgcccaggtttgtgttcatctgagataaaaaaaaaaatggccaattctacc

SEQ ID NO: 357 - DNA, 1066 bp, Saccharum
aacaagaacacatatattgtcaggtaagtttaactcgatacattatatagctgctgctgacgtactgttatgtgttgttgtaaattcagcatggcaatatacaggaccaaaagcaaaaataaacccaaacaacaaagcttatcactttacgcaacaaatttatcatcatccacaggagggcgcagaattagcatgacaaaagcatgttaacagcagctgcttgcggcggcgtcagcttccggaggcttctgcttgaagatgttcttcttggcccctgaggaagcatccgccaggaggcttggcgtgtctaatatctttagaacgagttcctcaaagcactgttctacatttacttttgtttttgcactgcattctagaaataaacatccatattccctggcaaattcaatcccctcctttttcgtgacagctctctcactttccttgtctactttatttccaacaagcatctttatacagtcctggttggttgaatacaggtcaatttccttcgcccatatatcagaaagatcggtaaatgtttctcgtcgagtgacatcatacaccataatgatcccctgtgcccctctgtagtaagagctggtcaaggtcctaaatctctcttgtccagctgtgtcccagatggcaagcttgagttttttgccaccaatgctaaccatcttcaccttgaagtcaacacctattgtgggggagaggtcctcgaaggagtcggcggtgaagcggaggaggaggctgctcttgccgacgccggagtctccgatcaggaggagcttgaaaaggtagtcgaagtcgggctgctggctcaggctggacgaggaggaggaggaggaatccatgaggatcggagagggacggggaggctagacgagatctagggtttgatccgacagcgagaggagataggaggcagccgggggaggggaggggcgtgggcggccgtcgggacgagcaggtcagcagcggtgctttcgcgccgggatgagcagatggacggcggccggcgccctcctctcgtcgcacggaaagggccgggccgggagagacg

SEQ ID NO: 358 - DNA, 1232 bp, Saccharum
gccaaatattgtattgacaattaacaaacatgttaacttacaaggtaccataataataatagtctcattgatgccctttacttaacaatcacacaagcttgattaacaacactggaataaaatcaccaagtagattctgggacacacggtaggggacatcacataacaccaatccagctacacacagatagattattgcttctggtccatgaacaaattgaacaagacaggtctccctccaactagtaattaaaacgcattatatttctagaaaaaccgcagcacactgcaagggcaccattcttttgacacaatggacagcatctttaacgctgcatcttcttcagctcttgttcttggacttgtccttcgttcttggtgcaagacctatggcttcagaactcttcatgatcctcagacgcttgcatgactcgacaaacatctcccatgggacgtcgccaacaagcatccagtcgccatccttgtcttcgtaagtagtgaccacatcagcaccgctgactggatcaaccaatttcccctcattcatgttgttcccagatgtggtgaaggtgttgaacatcttcttcagagcgatggagaggtccttgtagctgttgtacatcttcaggtccaccttgcgcaggtagggcgcaccgtccatgctgaccttcacgaaggcagagctgttgcagccggcggtggcagcggactgctgcttctcaggttcctcttccttcttgctcttcacagactggacggtcatgacgttcctgcggtatgatcggactggtggccaacccacagcttgtgccttgggtgcaggtggcttctcggcatcagcggccggcgcctcggcgggcctcttggccttctcggctgccggctccggcttgcctgcggcagcttcctccatgccggcggtgggcagcttcagcttgaggtcgatggtgtcctcgaagcccctcttcgcggccttggccgcctcggcgcctcctcccggcaggccgagccggagctccgtcccgacgtcgacgtcggcgccagccatcggcttcggctccgcaggagctagcagctggttgctggctagcctgtcgcggccgtcgttgtctctctcgccttgggcacctccacgctagctaagcttctgcttgctctcttcttcttcttcttagctcctctgctgcgcgtatgtgaggaaggagagatttggggttgccggacgcgtgggt

SEQ ID NO: 359 - DNA, 1141 bp, Saccharum
cgctcaattcccattccaagtcccccgctcccggattcccggcgacgagctcagagctcctcctccccagccccagctcggtgctcgaagcgacagctgccgccatgtctgctgccaaccagctcgccgccctcatcgccaacatgttcgccacgggtttgcttgacgatcaattccagcagctccagttgctgcaggaccccagcgcccctaacttcgtgtccgaggtcgtcaccctcttctgccaggacggcgagcggatcatcggggagctggccaaacagctggacaagcccagcgtggattttgacagggtcgacgccttcgtgcatcagctcaagggtagcagtgctagtgttggcgcgctgaaggttaagaacacttgcatccagttccgcgaattctgtcagcagaagagcaaagatgggtgcctcaagacactggagacggtgaggattaacttctatgagctgcgtggcaagtttcagaccatgcttcagctggagcgtcaggtcaatggctttccccccaacaattaaaccagatggcggagtggagcttcatgttgggatgatgcatgcacctttcaagtctcagaacattctgaatgagctcctcagttggcttctgggaagcctgtaatagcttagcagcaggattagtgttgacaccaccgtagcagtagtcattgtcatcgtctttgtgtcatcgaagtagtagtcgtaagtgtctgctgggtgatggatctcctgcaagcagttgctggtggtctgtttactctgtagtagtcgctcttaataatctatctcttaggagtctgctagtggaacttggtggtgaaacaaaataaaatgctatggctattggttagtaataataggctgctgtgtttggtaacatgtgcgtgctgtgtgatgtgctatgtgaaagtgagcctgtcgttggatcatggtttgtatcaatgcagatttttcaggttggtggcgcgactgtcagggcatcaggggggcctgccctatcaatggttgttttgcttccccttgagttgttttcccttaacattctatgctcttatctagattctgtacagaatgtttagtcctttgttactcctttcttggccataatcttgacatgttct

SEQ ID NO: 360 - DNA, 1336 bp, Saccharum
agaggaaaatatgatttgccatttatagtagtacgtaaacatccttttcatacatcaggccgatcgatcggatccataccaaatacacagtactacatcgcacacttcagcagacgtcgtttcgtacacgcttaactgctcaagatcaaccggccgcgtagctaaagcatattaccaccaccacgcggccgtacttttgtctatagctaaacacgcgaaaagcacacgtgctccgccgcacgccgacgagggagcagcagagaaaccccgctccgggcgaccggctcacagctcactccaggtcctggcaccccgcgagcggggtccccttgcggcactggttgtgcgcgtacggcttgcacccgtgcttgatcacgccgtggcccttggggagcggcccgcacaggcggttgtagctgaggtccagcttctgcagcgtggacagccgctccagcgacagcggcacggtgccccggatttggttgtgggacaggtccaggtacgtcagctccggcgggaacaccagcttgctgaggtcgaagtcgaggtagttccacgacaggtccaccttgccgatgggccggccggcgacgaacaggtgggaggggtcgccggtgagcttgttgtgggagaggtccacggtgttgatctcgtcgtgcgcgtcgtcgcgcgggatcgggcccgtcagctggttgtaggacaggatcagcgaccggaactgcccctgcaccagccccgccgggatggtgcccgtcagctggttgtgccggaggtccagcgaccggaggttgggcaggtcggcgaacgacgccgggatgccgcccgtcagctggttgctggagaggtccacggagtcgaggctgcgcagccgcgccagggactccgggatggcgccggacacgctggtgtgggagatggtgaggaactccagcttggacagcgcggtgaggcaggtcgggatggagcccgtgagccccggcagcttgaacagggtcagcgacatgagctccgtcagcccgcccaccgcggacgggatctggccgtgcacgtcgtccgcggcgtcgatgaagacgttgttcacgcgcccggcgtcgttgcaccggaggtggtcccacgcgcagcagttgggcgacgacgcggtccacgtcgacagcgtcgccgggttgcccagcgcctgcttcacgctcagcagcgcgtgcaggtcgctcggtgagcaggaccgcgccggcgccgcggacgccgacgccacgagcaggaagacagcgaggaaggtggtggtggtggacgccatcgcgctcgtgtgcgcgtgctgggagagctggctctcgagtgtggt

SEQ ID NO: 361 - DNA, 3047 bp, Saccharum
cggccagccccacccctacctccctctctctctcccccccacacacgcaccaaggcgatctccgagctcgggtgagccgacgagaatgcggccgatttgaggaacgcggagggcgcgatggatgcgggttcggtcgacggatttgcgaggaggctgtagaggttaggtttcggtgtgtgtgcccccggcccggccggtcgtgggagatgagctcctcgtccgcggccagcatcgggcagccgccgccgcccgcgccgccgccggaggaagagaagaagtgcctcaactcggagctgtggcacgcgtgcgccggcccgctcgtctgccttcccaccgtcggcacgcgcgtcgtctacttcccgcagggccacagcgaacaggtggcagcgtcgacgaacaaggaggtggacggccacatccccaactaccccaacctgccgccgcagctgatctgccagctccatgatgtcacaatgcatgcggatgtggagacggacgaagtgtacgcgcagatgacgctgcagccgctcaacccacaagagcagaacgacgcgtacctgcctgcggagatgggaatcatgagcaagcagccgacgaattacttctgcaagacgctgactgcgagcgacaccagcacgcatggcggcttctccgtgccccgtcgtgctgccgagcgcgtctttccccctctggatttcacacagcagcctccagcacaggagcttattgcacgggatattcatgacgtcgagtggaagttcaggcatatcttccgagcccaaaagacacctgctgactactggctggagtgtgtttgtcagtgctaagagacttgttgctggagattctgtgctattcatatggaatgagaaaaaccagcttttgcttggaatcagacgcgccagccgtccacagactgtgatgccctcttctgttctttcaagtgacagcatgcacattgggctccttgcagcagcagctcatgctgctgcaacaaacagtcgcttcacaattttctataatcctagggcaagtccatcagaatttgttatacccctttcgaaatacatcaaggctgtttttcacacgcggatatcagttgggatgcgattcaggatgttgtttgagactgaggaatctagtgtccgtaggtacatggggacaataacagaagtgagtgatgctgacccagtgcgttggccgagttcctattggagatcagtgaaggttggttgggatgaatcaacagcaggagaaaggccgcctagagtttctctgtgggaaattgagccactgacaacctttcctatgtatccatccctgttcccactgcgagttaagcatccttggtattcaggagttgctgctcttcatgatgacagcaatgctttgatgtggctgagaggagttgctggtgaagggggctttcagtctttgaacttccagtcacctggtataggttcctggggacaacagaggctccatccatccttacttagcagtgaccatgatcagtatcaagcagtggttgctgctgcagctgcctcccagtccagtggttatctgaaacagcaattcctacaccttcaacagcctatgcagtccccacaggagcagtgcaatctcaatccgctgttgcagcaacaaatactacagcaagcgagccaacagcagatggttagtcctgatgctcaaaatattcagtccgtgctcagcccaagtgctattcagcagcagctccaccaactccagcagatgcagcacgctcataatgaccagaagcagaagattcaaccagatcaaccgtatcaagttcctagcagtgcagttctcccgagtccaacgtcattaccaagccatttgcgtgaaaaatttggcttttctgatcctagtgtgaactcttccagcttcatcagctctagcagcaacgaaaacatgctggaatcaaacttccttcagggaagttcaaaatctgtggatttgtctagattcaaccaaccagcagttagcgagcagcagcagcagcaacaggcatggaagcagaagtttatgggctcacaatcgatgtcttttgggggctcagtttcgcttaactcacccactagcaaagatggttctgctgacaacaaaattggtcgtgatgtgcagaaccagtccctttttagccctcaagtggactcttcctccctactgtacaatatggtacctaatctgacctcaaatgctgcggataataatatatcagcgattccatctgggtcaacatatctgcagagtccaatgtatggttgtctggatgactcttctggtttattgcaaaatacaggagagaatgatccggcaactagaactttcgttaaggtttacaagtcaggatcagtggggagatccttggacatcacccggttctctaattatgctgaacttcgagaggaactgggtcagatgttcggcattaagggtcagttggatgaccctgatagatcaggctggcagcttgtatttgtcgacagggagaacgatgtgcttctccttggagacgacccgtgggagtcatttgtgaatagtgtatggtacatcaagatactttcaccggaggatgtgcataagatgggaaagccaggaaacgatccacgctacctatcttaaattgatacactggagctctttctggctcccatgacgattctgcggcacactgaagcactgttcatgacggcctgctctgctgtgctcgcatgttcgcccgtgtcatctctagcatgtacaccgtgcacgtcttcagaactccccgttacttgtatccggtgcaggccaccgctctggactgatattttgtaggttccacttaggaatcagtatcagcaactctatcctagttggtttgtagctcgcacggcactcgttcttgtgtcgcatcaaaatcttcagactaaatgcttagttgaaactgttctcgtgattcgtaagttatctatgtatttgaggattcctcgacatgctttcgacgatgaactgcaataatttgaatgcaggaggattgtttg

SEQ ID NO: 362 - DNA, 582 bp, Saccharum
gtaagtagctagtcctgcatgtgttgcagggctgaccgcctgttacaatataattaatacctgttcttcaactagaggatccctagcgttgcttgctgcttcttatttgactgactttctcatgcctatgctatcatctatcagcaggcttcaattccatatatatggagttgaagttgttgatctgtggcttgttgtaacaaaatatatatattgttactccggccagtgttgccttgagaatcatttttgcttatgatggttttgggcggcccagccgtgagcagcagtagtgttcaagtcatggtcagtttggtagtagacaacatccccatggtcgctgacgaagtggtcgactctgaggctcctgaggagcacgccaaggaggtgcagtggcagcggccctgacttctgtggctcccggtagtatcggcccagcaccggcttggctgccttggtagcttcgacaagatggtagtgcgggatctgcgggaagaggtggtgaatgacatgggtgccgatgtcgtggtggatattgttgatccagccgtagtccctgtccaccgtcgtgagcccgccgcg

SEQ ID NO: 363 - DNA, 1170 bp, Saccharum
ctcgcccctctctccaaacagtccacagtccacacgcgtagtttccttgtccttccggcgccccctcccgccgcacctccgtcggaggcgccccggcggaagaagccaatgagtttggctcccgcgcacgggactggagatgccctgcctgaccctgcaatgcaatccgtcgccggtcgctgatcagtcgagctcctgattcttgggggcccatcgccgtgtttcccttgttgcccgctttggccgtgcattaatagccgcttccttgtgatagtcctctccctccgtcctcccttccctgttccctcccccctctcctctctcctctcgctcgtctccttggtcggctctgttcttgggagtgctgccagtctggttgcgttgtggcagcaaaaacttcatcgacaacatctgcctgcgccgttctgatgggtttgggttgcttcgggtgcttcgcgccggaggtggatgaggacctcaagccctccaagcacgacgactcgtcaggggccgatgcgaggaggaaggtcgcgccggatgtggccaacggctacgcccacagcttcaccttcaaggatctgcttgtggccaccggctacttcaacgaggccaatttcatcggagaaggtggatttgggaaggtgtacaagggcaagatcaacggacagatggtggcagtgaagcagctcgctcgagatggcgtgcaggggaggaacgagttcttggtcgaggtgctcatgctgacagtgctcaaccaccgcaatcttgtcagcttggtcgggttctgcgcgcagggggacgagagactgctggtgtacgagtacatgccgttcggaagcctggagagccatctgtttgatgtgcctcttggcaagaaaccacccgactggaacacacgtgtgaggatagctgttgaagtcgcagaagggctttcttacttgcacaatgtggctgatccacctgtcatttaccgtgatatgaaagctgctaatattctgcttggtgaagacttcagcccgaagctctctgactttgggcttgcaaaagttggacctgtcggagacagaactcatgtgtccacaagagttatgggtacctatggctactgtgctcctgactatgtcgtgagtggtaaacttaccatgaaatccgacatatacagtttcggtg

SEQ ID NO: 364 - DNA, 956 bp, Saccharum
gcaggtccattggcaaatgagttcccttcaagtgttagatctggaatggagctgaattcttttggtatccaaccactgaaattgttgtttgctatgtttaatgtagtaaggcttagcccacggagaacattgacagaacccgttaactgattgttttgcatataaagacttgaaaaatttgataaagaaccaatagaattgggaagatcccctgtcaatttgttgaaagatacatctaactctgaaagtgaattgaggcttccaaatagatcacccagttgctgagaaagtgagttgtgactgagattaaggtattcaatcgaagccatatttgatatagagtatggaaggttgccattgaaattgttgctacccagattcagatgagtaagattaggtggcagctggtaagggattgaaccatgcaagttgttattgctcaaatctagcgttttcaaagagaacaggttggagagttcgtatcccagagaaccatcgagccctatccctggaagtttgatttcggtgacgccggcgccggagcaggtgacgccctgccacgccgcgccgcaggggtcgccgccgctggccgaccacccagccagatgcgacgggctgttccaggaggtgtagaggttccccagcgccgcggcgtcggcggagtcggtttcggcccccgctggcgccgccgcgagggcaaggagaaggccggtggcgaatgcggcggccagcgcctccatgcttggtctggtccccacactctctccctccctcttgacccttctccctccgcggcagcgaaagactgctgctttccttggccgcttatcccctaccaggaggacacggccatggtgtccagcacggggatcaccatgggccgcacggcgggcggttcacctctctcttctccgctggttcactacgtagagcctcgtttagttccccaaattcac

SEQ ID NO: 365 - DNA, 1707 bp, Saccharum
agcaatggcctagcccaagagaccaatgtctctggctgatactctgaagatgtcatgattggcttcctcccagtgatcagttccagaagcatcacgccgaaggagaagacgtcggaccggtcgttaactttgcctgtggcagcgtactctggcgccagatatccgaaagttcccattacgcgcgtagaaacagcggtgacttcagctgcttggtatttggccaacccaaaatctgcaacctttggctcgtagttgtaatccagaaggatgttcgcagccttgatgtcacgatggatgatcttaggatgacagtcttcgtgcagataggcgaggccattgaccgagccgaccgcgatcttccaccgcctcggccagtccaatgtcggcctgccactcccgtggagctggaactcgagggtcttgttgggcacgtactcgtagacgagcagccgctgttcgccgtagaggcagtagccgacgagggagacgaggttcttgtggtgcacgcggctgatgatctccacctcggcgcggaactcgcggtcaccctgcccgcttccggcccgcagcttcttgatggccacctcctgcccgcccaccgtgccgcggtacacgtgcccgaacccgccctgcccgagcaggttcgcgtccgagaacccgtccgtcgccgccgccaggtcgtcgtacgcgaacgtgccgcccgtgatggccggcgaagggttcagcggcggcatcggggactcggacgggccgcggctgctctgccacgagtgcatcagcggcggcgtcgaggatggcgtcgtcgacggcgcgtgcgacatgtacggtggcgtcaccggacgccgcgggtcgtagaactcgcctgggaacccctgagacggcggcggcgaccgccgccgacgtttccttcccatgaagcagtagatgagcccggcgacgaggccgagcacgaccaccgccgcgacggcgacgcctatgcccaccgcggtgctgttgctcgacgacttggaaggcgatgacgacgttggtggtgttcctgtcgacggggctggcggcggaggtggaggcaatgacagatgtgacggcggaggcgcgggtgacgccgggacgccattagggggcggcggcgaagatgggacggaatcaggaggtggcggtgacgccgggacaccactgggaggaggcgggctgcgtacaggcggaggcggtgatggagttggcacagtcgccggtggtggaggagatgccggtggaggtgaagatggtgttggtacgctcgctggcggaggcggggacggcgtcaccggcggtgggggcgacggagacggaggaggaggggacggcgtgggcgtgggcggcaccggcgcgggagttggggggagcggcgatggcgtgggcggcaccggagcgggagttggtggtatcggcgatggcgtgggcggcaccggcgcgggagtcggcggtatcggcgatggcgtgggtggcaccggcgccggagtcggcggctgcggcgatggcgtgggtgggaccggcgccggagtcggcggcgatggcgtgggcgtcaccggagccggtggtgaaggagatggcgtagccggcgacgttggcgctggagacgacatggcgccgccccgctcgcttgcggtggtgcggcgcgcttgtgcaacgtttgtcgccgccccgttaccggtggactacgaccaaact

SEQ ID NO: 366 - DNA, 1101 bp, Saccharum
gcagagccagaggtggcgttatagttgagctcgatatgttctcagaagtcagagctgacgctatacaccacagccagcatttcaactcaactgcgagttaaacaacctactattcctatcccttatatatatatacgaatttcagttggcagaatcctaatatgatgaagctatgaacaagccactattcctctcctgctccagatcaagctattcttgcgcctctggtctactcatagtgctccacaaactgcatcggctccgcgagatacgagcagtcatcatcccaaccgcaaggccgtccacttaagtcctcgacgtcgaagccagccacggccttgtctgcttctcgccggtccatttcagcgcctggtatcgcgtccagctcgtcccacacatcataccaaataccttccatctcctgaccattcaactcaggcccaggctcctgttttgcggttatgccaccatcgctgctccccgcagagacgccagccgccactgtcgcaaatgcagcttcggtgctactcctcagtggcaaatcgccgtgccattgttcttcgttttccatcagccgctgtcttttggaagcgccgcgtagctctttctccttggcatagttgagcaggacctgctgaacgaaggctgggttgctgagcacctttgtgaagaaggcgatggccctctgctggttcctctcgttgttcaggatcctctcctccaaggcgacgagttgggatttgcaaatgctgtactgctgccttagcgtgatgacttcagccctgagtgctgcgcggtctcgtttcaagctctcgacctcactgggatcctttggcggtccgagacaagcacttgcacattttcttggctgtgcttccatcggaggcttggaagcacgcctcctcttgatatttttcagcaaatgcttctggcctgctaagaaggattcgtttgcaaactcccaacgatccggattcaccttcctgaatccgtagatgttgagctgcctgatgaaggacgcgaagttggcgtgcttgaagaagcgcgggaggatgccggcggcgagcgcctgcgggtcccacaccacgaagctgttcccgg

SEQ ID NO: 367 - DNA, 1077 bp, Saccharum
ccttgaactccgccggcccgaaccacgcctcctcctgcccaccaccgccgccgtgcatcaggcggcccatctcctcgtcgctggcgccgtggcggaaccacgggtgcgccacgatgccgtccgcgtcaatgcgcgccgacgggtccgggtccagcacgcgccgcagcaggtcgcgcagcgccggcgagaaccacccggggcaccggaacctgcccgcgtagatcttgcggtacatgttcacaaggctcgcgtcgttgaaggggaggtaacccgccgccagcacgaacagcaccacgccgcaggaccagatgtccaccttggccggctcgtaccctttccgcgacaggatctccggggccacgtacgccggggtgccgcacatcgtgtgccggaggagactactaccgtcggcggcggtggccacggcgccgagcccgaagtcggccaccatcagcgcgccggcctcgtcgagcaggaggttctcgggcttgatgtcgcggtggtacacgccgcgcgcgtggcagtaccgcacggcggacaccagctgccggaagtagtgccgcgccaggtcctccgtcatgcggcccgacgcgtccaccagcgagaacagctcgccgccggcggcgaggtccagcacgaagtggaccttcttgcgcgtcgccaggatctcgtggagccgcaccacgtggcggtgccgcaggcgacggaggatgcccgcctcacgctcgatggccacgggccggtcaccctgcggcgcgcgggttggggaacgacttgatggccacggaccggcccgtgagcaggtcccgcgccaggtacaccttggcggacgcgccgcggcccaggaggccgccgagctcgtacctcccgaggagcacggtcccggcggcggggggagagtcggcggcggcggatgcgacggcgccggtggcgggcggcatcgtggcggcggcgtctgctcggccggcgccgtcgtaatggccggacgcgacggggaaacttttcttgtaccgtaccgtctcactggccggtgtgatcacggtcgtgctgggtagctttgcggctggctggctgggg

SEQ ID NO: 368 - DNA, 1720 bp, Saccharum
cacgcgtccggatgggaatgggactgaactttgggaggtttataatgggaacaacgtgaggctcccatggaagttggaggaattcgttgccagaagcccatatattcgggattctgttgttactgttggatcaaaagtttcaaccgtttttgtagttaatgctgatactggtgagattatttacaggcacagtattccagctgcgttaaatgaattggaaggaccagggattgaaggagcaccatccaagctaaatgcccgtactagtgatggcagtgagaagatcatagtgcttgtgagaactgactattctctcagcgcatcagatcttggcaagcatttatttaactggacaagaacttctttcactgcaaaccaatatgcgaaatacaaccaccctgacatgcttgatcagtcaccttgcctgcgaggagatattccatgcgttagaactgagggtttgccacttgctttacctgattcagattcagattcagattcagctaatgtaattgtcttgaaagatggtaccccttttatttccatccatggttctgatgctctggaactagttcaaaccccaaggaagctaccaaacactgctgggaagtcaaatatcgtattggatgattctcaaaatcaaacttatgatggtgctcaatctcatgtcatctctgctgatcccaaagctaccaaaaaccccactaggaacacttatggatggttattccctttgtttcccatatttttggtcattggttatctgttgagcttgatctctgcaagcaagtcatgcaggcaatttgtgattcagcttattaagccattcacgcacaacaagaaatcagtggacattagaggcaggtcagagggaactcctaaaagaagaaaaacacggaagaaggatggacttgtcaatagccctgagaccttgacagcatctgacaaggagtgcagtgaaactggtgggtcaactgaggcaccaatggaaaactctgcgctaacagatgcccttggtggtcgtcagattggtaaactatatgtctccaataaagaaattggtagagggagcaatggcacagttgtttttgaaggatcttatgatggtcgtcaagttgctgtgaaacgtctgctgcgttcccacaatgacatagctgaaaaggagactcagaatcttattatatctgattgtgatcctaatattgttagactctatggttgtgaccatgacagtgattttgtttatatctcccttgagaggtgccactgtagcttggctgatctaatccagaaacactcatatttgtcttctggagagtctatttctaacaatgaggtcagtgtcagcatcaagtcaaaggtttcaaatgttaagggaatagacgtggaattgtggacgcaggatgggcttccttcagcacatctcctgaagctgatgagggatgtggttgctggccttgtgcatttgcataacttgggaattattcatcgtgatttgaagcctcagaatgtcttaataagcacagaaggacctattagagcaaagctttctgatatgggtatcagtaagcacctgcaagatgacatgacttctgttagccaccatggtacaggaattggaagctctggctggcaagcacctgaacagcttcgtcatggtcgtcaaactcgtgcaatggatctttttagtttgggctgccttattttctattgtatcact

SEQ ID NO: 369 - DNA, 739 bp, Saccharum
gattaattgttggaagggaccccttgcctcatcttccctcattcgaccatggttacaattgcgtcaaagagctcgccaccagtagcaaattctaacacaatgtagatctttgttttacttcccatcacctcatatatgcggacaacattagggtgcttgatcaacttcatcgtcgagatttcccgcttaatctgctcaaccatcttgtgcttgagtaccttctccttatctaggatcttgatggctacggcctcgctggtcaccgtgtccctcgcgaacctgacctttgcgaatgtgccctcgcctatggtgcggccgagctcatacttgcccacacgtctcttcaccttggttgtactcattccctgccttctcaccccctttggaacggaatggaatgaatgtcaggagtcttctccgctcggtcctgtggtttcactgtcaggcagctggatgaaccaagtcgagtccgaggagcgcagagctcgcagatgcccgccctgtatcctggtggcgaaaaggatctcgggaagcggccgtcgagggagacgaagagctgggtggcgcctcggctcgggggcagcaggcagacaagcagctgctgtcacgggaggagaggcagcttgatggcctctagagtatatagtggcagtggcagcagcagagcagggagggagatggagatgcagcgagaggtgggggacgaagatgaaggacggccggaaggaaggaatgaatg

SEQ ID NO: 370 - DNA, 637 bp, Saccharum
ggaattcattcattccttccttccggccgtccttcgtcttcgtcccccacctctcgctgcatcttcatctccctccctgctctgctgctgccactgccactgtatactctagaggccatcaagctgcctctcctcccgtgacagcagctgcttgtctgcctgctgaccccgaggcgccaccgccctagcagccgcttcccgagatccttttcgccaccaggatacagggcgggcatctgcgagctctgcgctcctcggactcgacttggttcatccagctgcctgacagtgaaaccacaggaccgagcggagaagactcctgacattcattccattccgttccaaagggggtgagaaggcagggaatgagtacaaccaaggtgaagagacgtgtgggcaagtatgagctcggccgcaccataggcgagggcacattcgcaaaggtcaggttcgcgagggacacggtgaccagcgaggccgtagccatcaagatcctagataaggagaaggtactcaagcacaagatggttgagcagattaagcgggaaatctcgacgatgaagttgatcaagcaccctaatgttgtccgcatatacgaggtgatgggaagtaaacaaagatctacattgtgttagaa

SEQ ID NO: 371 - DNA, 1775 bp, Saccharum
agcacactcccactgcggcccaagcaaagcaaggcgggcggcggtattagtagcaccagcggcttgctccgcgtcgtcatcggcagcgcgcgctcgcgattggctcctcgtagctatctgtctacagaaataatcacaagcgctagcaagagaggggccggcatagagagtcttggacgggttcagagggctcaagggagaagaagaggagggttcagagttgggaggagatggagagcccgcggagccccgaggccgagatcggccaccgcgtggaggacctctgggaggtggcggagccgcagctctcgccgtcggagaagctcaactcctgcttcgaggacatccccgtcgcgtccttcccgcgcacacacccgtcgcaagtcattgagattccttcagatgcaagtcttgctgaaactgtagaaatattatccaaaaacaaaatcttgagtgcacccataagaaatgttgaggctccagaagatgctagttggatggacaaatacatcggcattgtggaatttgctggtattgccatgtggttgctcagtcagtctgatgctgtggttaatgggacggttggttcgggagcaggatcacctgtctccaatctagtttctaggctgggctcattcacattcagaaggacatcatctggcagggtagaaactgctactgattctgaatcagatgaagcagcctcagttggtggaagcttttttgaaaccctaacttcctctgaattctacaagaatacaaaggttggcgatatctcagggagcttccgctgggcaccatttcttgcactgcagacatctgacacattccttaccatgttgctgcttctatccaagtacagaatgaagagcctgccagttgtagaagtgggaggagataagattgagaacattatcacacaatcctctgtcgtacacatgcttgcagagtgtgttgggctctcctggtttgagagctggggaactaagaaactctctgaactggggcttcctatcatgaaaccatcgaaacttgtcaaggtaaacgaagatcagccagttctgaaagctttccaactgatgagggaaaagggagttggtggcctgccagtcatggacacaagtggagcaaaagcaattggtaatattagcatcagagatgtccagtatcttttaactgcccccaagatatacaaagagcacaggtcaatcacgacaaaggatttccttagtgctgttcgacaccatctccaggagcaacgtgaggcctcaccattgctgcatgatgtaatcacttgcaaaagggatgatacaattaaggacatcataatgaagctggactctgagaagatccacaggatctacgttgtagatgacaaagggaacaccgagggagtcatcacgttgagggacataatctccaagctggtgcatgagccgcgccattactttggggatttctttgatggtgttgttcccctgcctgcaaacagcactgtatgacaacttcagggtccaatcacactgatgtatctgtgcaaatgtacattttgagctattctcttctgaaggttgcttctagtatattccttttcacagccttcttagttctcaggtaaacagaccattgcctacatggagaaaagaactaatgctctaatggatggatggcagtgttgtacattgaataatttgggaacttacctgagtttcttttcatgttctcatgatgacaattgttgcctgtcttgcttcttgctaaagatgtggttcact

SEQ ID NO: 372 - DNA, 1250 bp, Saccharum
ctcttctcttgcttgccaaccttcttctcttcccctactagttccctgccccatctccctttcctttcctctcctcctccgtctcggtgtctccgtctccatcttcatctccatctccgccttccctcctcgcctagcctagcccccccgcacgccacgccgcattcgcatctccggatccccattccccgccgccgccgacccacccggcctcccgcttcgatctcgccccgattccccgcgcccgcccgccccccacccgattcgtccctgtcacgcgcgcgcgggtgggaagacagcgatggctcgtggcgggggcctctcgccccgccgcgggtgacctcggggagccctcccgcgtgcccacgcggaggatcccgtcgcggctggtgccccacctcctcctccccttcgactctagggtttgctcccttcctcaccacccgatttcatttcgtcccttccggctaggctgctccgtctctctccgccatgttctcgcacggcgctgattccgcccacgacgccggggccgtcgccgtcagcagcggcggggccaccgtccccacccgcttcgtttggccctacggtggcaagagggtcttcgtctcaggctcctttaccaggtggtcggaacatttgccgatgtctcctgtcgaaggctgccccactgtatttcaggctatttgcagcctgtctccagggatccacgagtacaagttttttgtggacggggagtggcggcatgatgagcgccaacctactatatccggggagtttggtatagttaacacattgtacttgacaagagaatttaaccaaataaacgccttattaagtccaagcacaattggaagcaggatgaacatggatgtggataatgaaaattttcaacgtacggttacgttgtcggatggtactgtttcggaaggtactccgagagtttcagaggctgcaatacaaatctctaggtgccgcgtttctgaatatctgaatttgcatacatgctatgatttactcccggattcaggcaaggttattgctctggacattaatttacctgtgaagcaatcttttcatattctacatgaacaggggattcctgtagctcctctgtgggactcattcagaggtcaatttgttggtcttctgagcccattggatttcatacttatattgcgggagctagaaactcatggctcgaacctgacagaagagcagcttgaaacacacactatatctgcatggaa

SEQ ID NO: 373 - DNA, 560 bp, Saccharum
tcatccatccgtccgccgttcctcagctgtccggttgcatccatcccagagcccatctccagcgagcgaggcagagagagagagagagagagagagagagagagagagagagagagagagagagagagagagagaggttgagggatcagcaaggtcggccacacgacctctgtcggcaatccggcgcgcgtgcgtttgtgaatggtgaacggcgagccggcgggggcggagtgcacgcgggcgtcgctgctggggaggtatgagatcgggcggaccctcggggaaggcaacttcggcaaggtgaagtacgcgcgccacatcggcaccggcggccacttcgccatcaagatcctcgaccgcagcaagatcctctccctccgcatcgacgaccagattaggagggagatcgggacgctcaagctgctcaagcacccaaatgtcgtccgcttgcacgaggttgctgctagtaaaacaaagatttacatggtgcttgagtttgttaacggaggcgagctcttcgacaagattgttataaaggggaaactgtctgaatttgaggg

SEQ ID NO: 374 - DNA, 35 bp, Artificial Sequence
  Primer
ccctctagactcgagcattcattccattccgttcc

SEQ ID NO: 375 - DNA, 35 bp, Artificial Sequence
  Primer
cccaagcttgaattccgccaccagtagcaaattct

SEQ ID NO: 376 - DNA, 29 bp, Artificial Sequence
  Primer
cgcggatccgacgtcgtcaagtgccagat

SEQ ID NO: 377 - DNA, 28 bp, Artificial Sequence
  Primer
cgggatccgcgttggcgtagatgtaggt

SEQ ID NO: 378 - DNA, 331 bp, Artificial Sequence
  Synthetic Construct
cattcattccattccgttccaaagggggtgagaaggcagggaatgagtacaaccaaggtgaagagacgtgtgggcaagtatgagctcggccgcaccataggcgagggcacattcgcaaaggtcaggttcgcgagggacacggtgaccagcgaggccgtagccatcaagatcctagataaggagaaggtactcaagcacaagatggttgagcagattaagcgggaaatctcgacgatgaagttgatcaagcaccctaatgttgtccgcatatacgaggtgatgggaagtaaaacaaagatctacattgtgttagaatttgctactggtggcg

SEQ ID NO: 379 - DNA, 331 bp, Artificial Sequence
  Synthetic Construct
cgccaccagtagcaaattctaacacaatgtagatctttgttttacttcccatcacctcgtatatgcggacaacattagggtgcttgatcaacttcatcgtcgagatttcccgcttaatctgctcaaccatcttgtgcttgagtaccttctccttatctaggatcttgatggctacggcctcgctggtcaccgtgtccctcgcgaacctgacctttgcgaatgtgccctcgcctatggtgcggccgagctcatacttgcccacacgtctcttcaccttggttgtactcattccctgccttctcaccccctttggaacggaatggaatgaatg

SEQ ID NO: 380 - DNA, 535 bp, Artificial Sequence
  Synthetic Construct
gacgtcgtcaagtgccagatggaggacaaggacggcaagtacgagcggcggtactccgccgcccccgtcggcaagtggctcacccccaacgaggacggcgtctccatggccgcgctcacgctcatgaaccaggacaaggtcctcatggagagctggtactacctcaaggacgcggtgcttgacggcggcatcccgttcaacaaggcgtacgggatgacggcgttcgagtaccacggcacggacccgcgcttcaaccgcgtgttcaacgagggcatgaagaaccactcggtcatcatcaccaagaagctcctcgagttctacacgggcttcgagggcgtctccacgctcgtcgacgtgggcggcggcatcggcgccaccctgcacgccatcacctcgcaccacccgcagatcaagggcatcaacttcgacctcccccacgtgatctccgaggcgccgccgttccccggcgtgcagcacgtcggcggggacatgttcaagtcggtgccggcgggcgacgccatcctcatgaagtgga

SEQ ID NO: 381 - DNA, 19 bp, Artificial Sequence
  Primer
cttccagggcactcccatt

SEQ ID NO: 382 - DNA, 18 bp, Artificial Sequence
  Primer
cgggttcaaggccaccta

SEQ ID NO: 383 - DNA, 21 bp, Artificial Sequence
  Primer
gaaatcgagcctctccttcgt

SEQ ID NO: 384 - DNA, 22 bp, Artificial Sequence
  Primer
tgaagcggacgaatttgagtag

SEQ ID NO: 385 - DNA, 23 bp, Artificial Sequence
  Primer
gaacaccaggtcctggtagttgt

SEQ ID NO: 386 - DNA, 22 bp, Artificial Sequence
  Primer
aatcccatccatccaagctaag

SEQ ID NO: 387 - DNA, 21 bp, Artificial Sequence
  Primer
aggcattggaaacaaccatga

SEQ ID NO: 388 - DNA, 23 bp, Artificial Sequence
  Primer
tactacacgctgagccagatcaa

SEQ ID NO: 389 - DNA, 24 bp, Artificial Sequence
  Primer
catcttctcccactcgttcttctt

SEQ ID NO: 390 - DNA, 23 bp, Artificial Sequence
  Primer
ccggtcctttaaaccaactcagt

SEQ ID NO: 391 - DNA, 20 bp, Artificial Sequence
  Primer
tccgcatatacgaggtgatg

SEQ ID NO: 392 - DNA, 23 bp, Artificial Sequence
  Primer
ggaaatctcgacgatgaagttga

SEQ ID NO: 393 - DNA, 22 bp, Artificial Sequence
  Primer
ggacctctggtgcaacgtagtt

SEQ ID NO: 394 - DNA, 17 bp, Artificial Sequence
  Primer
cacggccactggaagca

SEQ ID NO: 395 - DNA, 18 bp, Artificial Sequence
  Primer
cgggttcaaggccaccta

SEQ ID NO: 396 - DNA, 20 bp, Artificial Sequence
  Primer
gagaactgcgcgaacatgag

SEQ ID NO: 397 - DNA, 26 bp, Artificial Sequence
  Primer
aggtgtgcgtatttacttgatgaact

SEQ ID NO: 398 - DNA, 20 bp, Artificial Sequence
  Primer
gcagcatcaggcagttcaac

SEQ ID NO: 399 - DNA, 22 bp, Artificial Sequence
  Primer
agctcgccatagagacttggat

SEQ ID NO: 400 - DNA, 17 bp, Artificial Sequence
  Primer
agcaaccgccctccaaa

SEQ ID NO: 401 - DNA, 14 bp, Artificial Sequence
  Primer
cggcggccgatcct

SEQ ID NO: 402 - DNA, 21 bp, Artificial Sequence
  Primer
gctttcagatgccgattcaag

SEQ ID NO: 403 - DNA, 20 bp, Artificial Sequence
  Primer
cactccacgtagggctcgaa

SEQ ID NO: 404 - DNA, 19 bp, Artificial Sequence
  Primer
agggatcgctcagctggat

SEQ ID NO: 405 - DNA, 22 bp, Artificial Sequence
  Primer
ccctctggtgtacctccatttg

SEQ ID NO: 406 - DNA, 20 bp, Artificial Sequence
  Primer
aaagagctcgccaccagtag

SEQ ID NO: 407 - DNA, 24 bp, Artificial Sequence
  Primer
ttgtttacttcccatcacctcgta

SEQ ID NO: 408 - DNA, 22 bp, Artificial Sequence
  Primer
cgctatctcagcaaatcaagga

SEQ ID NO: 409 - DNA, 20 bp, Artificial Sequence
  Primer
tcctcagggttcctgatgcc

SEQ ID NO: 410 - DNA, 26 bp, Artificial Sequence
  Primer
aggtgtgcgtatttacttgatgaact

SEQ ID NO: 411 - DNA, 389 bp, Artificial Sequence
  Synthetic Construct
tttccacgcaggacagtgaaaccacaggaccgagcggagaagactcctgacattcattccattccgttccaaagggggtgagaaggcagggaatgagtacaaccaaggtgaagagacgtgtgggcaagtatgagctcggccgcaccataggcgagggcacattcgcaaaggtcaggttcgcgagggacacggtgaccagcgaggccgtagccatcaagatcctagataaggagaaggtactcaagcacaagatggttgagcagattaagcgggaaatctcgacgatgaagttgatcaagcaccctaatgttgtccgcatatacgaggtgatgggaagtaaaacaaagatctacattgtgttagaatttgctactggtggcgagctcttt

SEQ ID NO: 412 - DNA, 364 bp, Artificial Sequence
  Synthetic Construct
tccagctgcctgacagtgaaaccacaggaccgagcggagaagactcctgacattcattccattccgttccaaagggggtgagaaggcagggaatgagtacaaccaaggtgaagagacgtgtgggcaagtatgagctcggccgcaccataggcgagggcacattcgcaaaggtcaggttcgcgagggacacggtgaccagcgaggccgtagccatcaagatcctagataaggagaaggtactcaagcacaagatggttgagcagattaagcgggaaatctcgacgatgaagttgatcaagcaccctaatgttgtccgcatatacgaggtgatgggaagtaaacaaagatctacattgtgttagaa

SEQ ID NO: 413 - DNA, 389 bp, Artificial Sequence
  Synthetic Construct
gggagcagagctacagctacctgacagtgaaaccacttggctgcgtgtagaatcctcctgagaccgacttcaaaaaggcagtaaggcagggaatgagtacaaccaaggtgaagagacgtgtgggcaagtatgagctcggccgaaccataggcgaaggcacattcgcaaaggtcaggttcgcaaagaacaccgagaccggagaaccggtagccatcaagatcctagataaggaaaaggtgctcaggcacaagatggttgagcagattaagcgggaaatttcgaccatgaagttgattaagcatcctaatgttgttcgcatatatgaggtgatgggaagtaaaacaaagatttacattgtgttggagtatgttactggtggcgagcttttt

What we claim:

1. A transgenic plant, wherein said plant comprises a vector expressing a recombinant polynucleotide, wherein the polynucleotide comprises the nucleotide sequence of SEQ ID NO: 106 or the complement thereof.

2. Seed, seed-cane, or setts of the transgenic plant of claim 1, wherein the seed, seed-cane, or setts comprise the vector.

* * * * *